United States Patent 11,931,406 (FLAVIVIRUS VACCINE) - sequence listing, part 22

SEQ ID NO: 9804 - RNA, 9876 nt, Artificial Sequence
  derived and/or modified CDS sequence (opt1) from DENV-2__AF169682__SS-prME
agcgcggggaugaucaucaugcugauccccaccgugauggccuuccaccucaccacccgcaacggggagccccacaugaucgucuccauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacuccaccagcaccugggugaccuacgggaccugcaccaccaccggcgagcaccgccgggagaagcgcuccgucgcccuggugccccacgugggcauggggcucgagacccggaccgagaccuggaugagcuccgagggcgccuggaagcacgcccagcgcaucgagaccuggauccugcggcaccccggguucacgaucauggccgcgauccuggccuacaccaucggcaccacccacuuccagcgcgcccucaucuucauccugcugacggccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugcccgacccagggggagcccagccugaaggaggagcaggacaagcgguucgucugcaagcacuccaugguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcaucaccgaggccgagcugaccggcuacgggaccgugacgauggagugcagcccccggaccggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugacguucaagaacccccacgcgaagaagcaggacgucgugguccucggcagccaggagggggccaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggugaaggagaucgccgagacccagcacggcaccaucgucauccgggugcaguacgagggggacggcucccccugccgcauccccuucgagaucauggaccuggagaagcgguacgugcucggccgccugaucacggucaacccgaucgugaccgagaaggacagccccgugaacaucgaggcggagccgcccuucggggacuccuacaucaucaucggcgucgagccggggcagcugaagcucaacugguucaagaagggcagcuccaucgggcagauguucgagaccaccaugcgcggcgccaagcggauggccauccugggcgacacggccugggacuucgggagccugggcgggguguucaccuccaucggcaaggcccuccaccagguguucggggcgaucuacggcgccgccuucagcggcgucuccuggaccaugaagauccugaucggggugaucaucaccuggaucggcaugaacagccgcuccacgagccuguccgugagccugguccucguggggaucgugacccuguaccugggcgucauggugcaggccgacuccgggugcguggucagcuggaagaacaaggagcucaagugcggcagcggcaucuucaucaccgacaacgugcacaccuggacggagcaguacaaguuccagcccgagucccccagcaagcuggcguccgccauccagaaggcccaggaggaggggaucugcggcauccggagcgugacccgccuggagaaccucauguggaagcagaucacccccgagcugaaccacauccuggccgagaacgaggucaagcucaccaucaugacgggggacaucaagggcaucaugcaggccgggaagcggucccugcgcccgcagcccaccgagcugaaguacagcuggaagaccuggggcaaggcgaagaugcucuccaccgagagccacaaccagacguuccugaucgacggccccgagaccgccgagugcccgaacaccaaccgggccuggaacucccuggagguggaggacuacggguucggcguguucaccacgaacaucuggcucaagcugaaggagaagcaggacgccuucugcgacagcaagcugauguccgccgcgaucaaggacaaccgcgccguccacgccgacaugggguacuggaucgagagcgcccucaacgacaccuggaagaucgagaaggccuccuucaucgaggugaagaacugccacuggcccaagagccacacccugugguccaacggcgugcuggagagcgagaugaucauccccaagaaccucgcgggccccgucucccagcacaacuaccggccgggguaccacacccagaucgccggccccuggcaccuggggaagcuggagauggacuucgacuucugcgacggcaccacggugguggucaccgaggacugcgggaaccgcggccccagccuccggaccaccacggccagcggcaagcugaucaccgaguggugcugccgcuccugcacccugcccccgcuccgguaccgcggggaggacggcugcugguacgggauggagauccggccccugaaggagaaggaggagaaccuggugaacagccucgugaccgccggccacgggcaggucgacaacuucucccugggcgugcugggcauggcccucuuccuggaggagaugcugcgcacgcggguggggaccaagcacgccauccuccuggucgccgugagcuucgugacccugaucaccggcaacauguccuucaaggaccucgggcgcgucguggugauggucggcgccacgaugaccgacgacaucgggaugggcgugaccuaccuggcccugcucgcggccuucaaggugcggcccaccuucgccgccggccugcugcuccgcaagcugacgagcaaggagcugaugaugaccaccaucgggaucguccuccugucccagagcaccauccccgagacgauccuggagcucaccgacgcccuggcgcugggcaugauggugcucaagaucgugcgcaacauggagaaguaccagcuggccgucaccaucauggccauccugugcgugccgaacgccgucauccuccagaacgccuggaagguguccugcaccauccuggcgguggucagcgugagcccccugauccucacgagcucccagcagaagaccgacuggaucccccuggcccugaccaucaaggggcucaaccccaccgccaucuuccugacgacccugagccggaccaacaagaagcgcuccuggccgcucaacgaggccaucauggcggugggcauggucagcauccuggccuccagccugcucaagaacgacauccccaugaccggcccccugguggccgggggccugcucacggugugcuacguccugaccgggcgguccgccgaccuggagcucgagcgcgccaccgacgugaagugggaggaccaggcggagaucagcggcagcucccccagccuguccaucaccaucagcgaggacggguccaugagcaucaagaacgaggaggaggagcagacgcugaccauccucauccggaccggccugcuggugaucuccggccucuucccggucagcauccccaucaccgccgccgccugguaccugugggaggugaagaagcagcgcgccggggugcugugggacguccccagcccgccgcccaugggcaaggcggagcucgaggacggggccuaccggaucaagcagaagggcauccugggguacagccagaucggcgccggcguguacaaggaggggaccuuccacacgauguggcacgugacccgcggcgccguccugaugcacaaggggaagcggaucgagcccuccugggccgacgugaagaaggaccucaucagcuacggcgggggcuggaagcuggagggcgaguggaaggagggggaggaggugcagguccuggcgcucgagcccggcaagaacccccgcgccgugcagaccaagcccgggcuguucaagaccaacacgggcaccaucggggccgugucccuggacuucagccccggcaccuccggcagccccaucaucgacaagaaggggaaggucgugggccucuacgggaacggcguggucacccgguccggcgccuacgugagcgccaucgcgcagacggagaaguccaucgaggacaaccccgagaucgaggacgacaucuuccgcaagcggcgccugaccaucauggaccugcaccccggggccggcaagaccaagcgguaccugcccgccaucgugcgcgaggccaucaagcgggggcuccgcacccugauccuggcgccgacgcgggucguggccgccgagauggaggaggcccuccgcggccugcccauccgguaccagacccccgccauccgcgcggagcacaccgggcgcgagaucguggaccugaugugccacgccaccuucacgaugcggcuccugagccccguccgcgugccgaacuacaaccugaucaucauggacgaggcccacuucaccgaccccgccagcaucgccgcgcggggcuacaucuccacccgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggucaccgacuucaagggcaagaccgugugguucgugccgagcaucaaggcggggaacgacaucgccgccugccuccgcaagaacggcaagaaggucauccagcugucccggaagaccuucgacagcgaguacgugaagacgcgcaccaacgacugggacuucguggucaccaccgacaucuccgagaugggcgccaacuucaaggcggagcgggugaucgacccccgccggugcaugaagcccgugauccugacggacggggaggagcgcgucauccucgccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcugcucgacaacaucaacacccccgagggcaucaucccgagcauguucgagcccgagcgggagaagguggacgccaucgacggcgaguaccgccugcgcggggaggcccggaagaccuucgucgaccugaugcgccggggcgaccuccccguguggcuggccuacaagguggccgcggaggggaucaacuacgccgaccgccgguggugcuucgacggcaucaagaacaaccagauccuggaggagaacgucgagguggagaucuggacgaaggagggggagcgcaagaagcucaagccgcgguggcuggacgcccgcaucuacuccgacccccuggcccucaaggaguucaaggaguucgccgcgggccggaagucccuggcccugaaccucaucaccgagaugggccgccugcccaccuucaugacccagaagacgcgggacgcccuggacaaccucgccguccugcacaccgcggaggccgggggccgcgccuacaaccacgcccuguccgagcuccccgagacccuggagacccugcuccugcugacgcuccuggccaccgugaccgggggcaucuuccuguuccucaugagcggccgggggaucggcaagaugacccuggggaugugcugcaucaucaccgcguccauccugcucugguacgcccagauccagccgcacuggaucgccgccagcaucauccugguguucuuccugaucguccuccugauccccgagcccgagaagcagcgcacgccccaggacaaccagcugaccuacguggugaucgccauccucaccgucguggcggccaccauggccaacgagaugggcuuccuggagaagacgaagaaggaccugggguucggcuccaucgccacccagcagccggagagcaacauccucgacaucgaccugcggcccgccagcgcguggacccuguacgccguggccaccacguucgucacccccaugcuccgccacuccaucgagaacagcuccgugaacgugagccugaccgccaucgccaaccaggcgaccguccugaugggccucgggaagggcuggccccuguccaagauggacaucggggugccgcugcucgccaucggcugcuacagccaggugaaccccaucacgcugaccgccgcccugcuccugcuggucgcgcacuacgccaucaucgggcccggccuccaggccaaggccacccgggaggcccagaagcgcgcggccgccggcaucaugaagaaccccaccguggacgggaucacggugaucgaccuggacccgauccccuacgaccccaaguucgagaagcagcugggccaggucaugcuccuggugcugugcgugacccagguccucaugaugcggaccaccugggcccugugcgaggcccugacgcucgcgaccgggcccaucuccacccugugggagggcaacccggggcgcuucuggaacaccacgaucgccgugagcauggccaacaucuuccggggcuccuaccuggccggcgccgggcuccuguucagcaucaugaagaacaccaccaacacccgccgcggcacggggaacaucggcgagacccugggcgagaaguggaagucccggcucaacgcgcuggggaaguccgaguuccagaucuacaagaaguccggcauccaggagguggaccgcacccuggccaaggaggggaucaagcggggcgagaccgaccaccacgccgucagccgcggguccgccaagcuccggugguucguggagcgcaacauggugacgcccgagggcaaggucguggaccugggcugcgggcggggcggguggagcuacuacugcggcgggcugaagaacgugcgcgaggucaagggccucaccaagggcgggcccggccacgaggagcccaucccgauguccaccuacggguggaaccuggugcggcugcagagcggcguggacgucuucuucacgccgcccgagaagugcgacacgcuccugugcgacaucggggaguccagccccaacccgaccguggaggcgggccgcacccugcgggugcucaaccuggucgagaacuggcugaacaacaacacccaguucugcaucaaggugcucaaccccuacaugcccagcgugaucgagaagauggaggcccugcagcgcaaguacggcggggcccugguccggaacccgcugucccgcaacagcacccacgagauguacuggguguccaacgccagcggcaacaucguguccagcgucaacaugaucucccggaugcucaucaaccgcuucacgaugaagcacaagaaggccaccuacgagcccgacguggaccuggggagcggcacccggaacaucgggaucgaguccgaggugcccaaccuggacaucaucggcaagcgcaucgagaagaucaagcaggagcacgagaccagcuggcacuacgaccaggaccaccccuacaagacgugggcguaccacggcuccuacgagaccaagcagaccgggagcgccuccagcauggucaacggcguggugcggcuccugaccaagccgugggacguccugcccacggugacccagauggccaugaccgacaccacgcccuucgggcagcagcgcguguucaaggagaaggucgacacccgcacccaggagcccaaggagggcaccaagaagcucaugaagaucacggccgaguggcuguggaaggagcugggcaagaagaagaccccgcggaugugcacccgcgaggaguucacccggaaggugcgcuccaacgccgcgcucggggccaucuucacggacgagaacaaguggaaguccgcccgggaggccgucgaggacucccgcuucugggagcugguggacaaggagcggaaccugcaccucgagggcaagugcgagaccugcguguacaacaugauggggaagcgcgagaagaagcugggcgaguucgggaaggccaagggcagccgggcgaucugguacauguggcugggcgcccgcuuccucgaguucgaggcccugggguuccugaacgaggaccacugguucucccgggagaacagccucagcggcgucgagggggagggccugcacaagcugggguacauccuccgcgacguguccaagaaggagggcggcgccauguacgcggacgacaccgccgggugggacacccggaucacgcuggaggaccugaagaacgaggagauggugaccaaccacauggagggcgagcacaagaagcucgccgaggccaucuucaagcugaccuaccagaacaaggucgugcgcgugcagcggcccacgccccgcgggacggucauggacaucaucagccggcgcgaccagcggggcuccggccaggugggcaccuacggccugaacaccuucaccaacauggaggcccagcucauccgccagauggagggggagggcguguucaagaacauccagcaccugacggcgaccgaggagaucgccguccagaacugccuggcccggcucgggcgcgagcgccugagccggauggccaucuccggcgacgacugcguggugaagccccuggacgaccgcuucgccagcgcgcucaccgcccugaacgacaugggcaagauccggaaggacauccagcagugggagccgucccgcggguggaacgacuggacccagguccccuucugcagccaccacuuccacgagcugaucaugaaggacggccgggugcucgugguccccugccgcaaccaggacgagcugaucgggcgggcccgcaucucccagggcgccggguggagccugcgggagacggccugccucggcaaguccuacgcgcagauguggagccugauguacuuccaccgccgggaccugcgccucgccgccaacgccaucugcuccgccgugcccagccacugggugccgaccucccggaccaccuggagcauccacgcgaagcacgaguggaugaccacggaggacaugcugaccgucuggaaccgcguguggauccaggagaaccccuggauggaggacaagacccccguggaguccugggaggagauccccuaccugggcaagcgggaggaccaguggugcgggagccucaucggccugaccagccgcgccacgugggccaagaacauccaggccgcgaucaaccagguccggucccugaucgggaacgaggaguacaccgacuacaugccgagcaugaagcgcuuccggcgcgaggaggaggaggccggcgugcucugguga

SEQ ID NO: 9805 - RNA, 9876 nt, Artificial Sequence
  derived and/or modified CDS sequence (opt1) from DENV-2__AF169681__SS-prME
agcgccgggaugaucaucaugcugauccccaccgugauggccuuccaccucaccacccgcaacggggagccgcacaugaucgucagcauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacagcaccagcaccugggugaccuacgggacgugcaccaccaccggcgagcaccgccgggagaagcgcuccgucgcccuggugccccacgugggcauggggcucgagacgcggaccgagaccuggaugagcuccgagggcgccuggaagcacgcccagcgcaucgagaccuggauccugcggcaccccggguucacgaucauggccgcgauccuggccuacaccaucggcaccacccacuuccagcgcgcccucaucuucauccugcugacggccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugcccgacccagggggagcccagccugaaggaggagcaggacaagcgguucgucugcaagcacuccaugguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcaucaccgaggccgagcugaccggcuacgggaccgugacgauggagugcagcccccggaccggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugacguucaagaacccccacgcgaagaagcaggacgucgugguccucggcagccaggagggggccaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggugaaggagaucgccgagacccagcacggcaccaucgucauccgggugcaguacgagggggacggcucccccugccgcauccccuucgagaucauggaccuggagaagcgguacgugcucggccgccugaucacggucaacccgaucgugaccgagaaggacagccccgugaacaucgaggcggagccgcccuucggggacuccuacaucaucaucggcgucgagccggggcagcugaagcucaacugguucaagaagggcagcuccaucgggcagauguucgagaccaccaugcgcggcgccaagcggauggccauccugggcgacacggccugggacuucgggagccugggcgggguguucaccuccaucggcaaggcccuccaccagguguucggggcgaucuacggcgccgccuucagcggcgucuccuggaccaugaagauccugaucggggugaucaucaccuggaucggcaugaacagccgcuccacgagccuguccgugagccugguccucguggggaucgugacccuguaccugggcgucauggugcaggccgacuccgggugcguggucagcuggaagaacaaggagcucaagugcggcagcggcaucuucaucaccgacaacgugcacaccuggacggagcaguacaaguuccagcccgagucccccagcaagcuggcguccgccauccagaaggcccaggaggaggggaucugcggcauccggagcgugacccgccuggagaaccucauguggaagcagaucacccccgagcugaaccacauccuggccgagaacgaggucaagcucaccaucaugacgggggacaucaagggcaucaugcaggccgggaagcggucccugcgcccgcagcccaccgagcugaaguacagcuggaagaccuggggcaaggcgaagaugcucuccaccgagagccacaaccagacguuccugaucgacggccccaagaccgccgagugcccgaacaccaaccgggccuggaacucccuggagguggaggacuacggguucggcguguucaccacgaacaucuggcucaagcugaaggagaagcaggacgcccugugcgacagcaagcucauguccgccgcgaucaaggacaaccgcgccguccacgccgacaugggguacuggaucgagagcgcccugaacgacaccuggaagaucgagaaggccuccuucaucgaggugaagaacugccacuggcccaagagccacacccugugguccaacggcgugcucgagagcgagaugaucauccccaagaaccuggcgggccccgucucccagcacaacuaccggccgggguaccacacccagaucgccggccccuggcaccuggggaagcucgagauggacuucgacuucugcgacggcaccacggugguggucaccgaggacugcgggaaccgcggccccagccugcggaccaccacggccagcggcaagcugaucaccgaguggugcugccgcuccugcacccucccgccccugcgguaccgcggggaggacggcugcugguacgggauggagauccggccccugaaggagaaggaggagaaccucgugaacagccuggugaccgccggccacgggcaggucgacaacuucucccugggcgugcucggcauggcgcuguuccuggaggagaugcuccgcacgcggguggggaccaagcacgccauccugcuggucgccgugagcuucgugacccucaucaccggcaacauguccuucaaggaccuggggcgcgucguggugauggucggcgccacgaugaccgacgacaucgggaugggcgugaccuaccuggcccuccuggcggccuucaaggugcggcccaccuucgccgccggccugcuccugcgcaagcugacgagcaaggagcucaugaugaccaccaucgggaucguccugcugucccagagcaccauccccgagacgauccucgagcugaccgacgcccuggcgcucggcaugauggugcugaagaucgugcgcaacauggagaaguaccagcuggccgucaccaucauggccauccucugcgugcccaacgccgucauccugcagaacgccuggaagguguccugcaccauccuggcgguggucagcgugagcccccucauccugacgagcucccagcagaagaccgacuggaucccccuggcccucaccaucaaggggcugaaccccaccgccaucuuccugacgacccucagccggaccaacaagaagcgcuccuggccgcugaacgaggccaucauggcggugggcauggucagcauccuggccuccagccuccugaagaacgacauccccaugaccggcccccugguggccgggggccuccugacggugugcuacguccugaccgggcgguccgccgaccucgagcuggagcgcgccaccgacgugaagugggagaaccaggcggagaucagcggcagcucccccauccugagcaucaccaucuccgaggacgggagcauguccaucaagaacgaggaggaggagcagacgcucaccauccugauccggaccggccugcucgugaucagcggccuguucccggucuccauccccaucaccgccgccgccugguaccugugggaggugaagaagcagcgcgccggggugcucugggacguccccuccccgccgcccaugggcaaggcggagcuggaggacggggccuaccggaucaagcagaagggcauccugggguacucccagaucggcgccggcguguacaaggaggggaccuuccacacgauguggcacgugacccgcggcgccguccucaugcacaaggggaagcggaucgagcccagcugggccgacgugaagaaggaccugaucuccuacggcgggggcuggaagcuggagggcgaguggaaggagggggaggaggugcagguccucgcgcuggagcccggcaagaacccccgcgccgugcagaccaagcccgggcuguucaagaccaacacgggcaccaucggggccgugagccucgacuucucccccggcaccagcggcucccccaucaucgacaagaaggggaaggucgugggccuguacgggaacggcguggucacccggagcggcgccuacguguccgccaucgcgcagacggagaaguccaucgaggacaaccccgagaucgaggacgacaucuuccgcaagcggcgccugaccaucauggaccugcaccccggggccggcaagaccaagcgguaccuccccgccaucgugcgcgaggccaucaagcgggggcugcgcacccugauccucgcgccgacgcgggucguggccgccgagauggaggaggcccugcgcggccugcccauccgguaccagacccccgccauccgcgcggagcacaccgggcgcgagaucguggaccucaugugccacgccaccuucacgaugcggcugcugucccccguccgcgugccgaacuacaaccucaucaucauggacgaggcccacuucaccgaccccgccagcaucgccgcgcggggcuacaucagcacccgcguggagaugggcgaggccgccgggaucuucaugaccgccacgccgcccggcucccgggacccguucccccagagcaacgcccccaucaucgacgaggagcgcgagauccccgagcgguccuggaacagcgggcacgagugggucaccgacuucaagggcaagaccgugugguucgugccguccaucaaggcggggaacgacaucgccgccugccugcgcaagaacggcaagaaggucauccagcugagccggaagaccuucgacuccgaguacgugaagacgcgcaccaacgacugggacuucguggucaccaccgacaucagcgagaugggcgccaacuucaaggcggagcgggugaucgacccccgccggugcaugaagcccgugauccucacggacggggaggagcgcgucauccuggccggccccaugccggugacccacuccagcgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgggagaagguggacgccaucgacggcgaguaccgccugcgcggggaggcccggaagaccuucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggacgaaggagggggagcgcaagaagcugaagccgcgguggcuggacgcccgcaucuacagcgacccccucgcccugaaggaguucaaggaguucgccgcgggccggaagucccuggcccucaaccugaucaccgagaugggccgccugcccaccuucaugacccagaagacgcgggacgcccucgacaaccuggccguccugcacaccgcggaggccgggggccgcgccuacaaccacgcccucagcgagcugcccgagacccuggagacccuccugcugcucacgcugcuggccaccgugaccgggggcaucuuccucuuccugauguccggccgggggaucggcaagaugacccuggggaugugcugcaucaucaccgcgagcauccuccugugguacgcccagauccagccgcacuggaucgccgccuccaucauccugguguucuuccucaucguccugcugauccccgagcccgagaagcagcgcacgccccaggacaaccagcucaccuacguggugaucgccauccugaccgucguggcggccaccauggccaacgagaugggcuuccuggagaagacgaagaaggaccucggguucggcagcaucgccacccagcagccggaguccaacauccuggacaucgaccugcggcccgccagcgcguggacccucuacgccguggccaccacguucgucacccccaugcugcgccacagcaucgagaacuccagcgugaacgugucccugaccgccaucgccaaccaggcgaccguccucaugggccuggggaagggcuggccccugagcaagauggacaucggggugccgcuccuggccaucggcugcuacucccaggugaaccccaucacgcugaccgccgcccuccugcugcucgucgcgcacuacgccaucaucgggcccggccugcaggccaaggccacccgggaggcccagaagcgcgcggccgccggcaucaugaagaaccccaccguggacgggaucacggugaucgaccuggacccgauccccuacgaccccaaguucgagaagcagcucggccaggucaugcugcuggugcucugcgugacccagguccugaugaugcggaccaccugggcccugugcgaggcccucacgcuggcgaccgggcccaucagcacccugugggagggcaacccggggcgcuucuggaacaccacgaucgccguguccauggccaacaucuuccggggcagcuaccucgccggcgccgggcugcuguucuccaucaugaagaacaccaccaacacccgccgcggcacggggaacaucggcgagacccucggcgagaaguggaagucccggcugaacgcgcuggggaaguccgaguuccagaucuacaagaaguccggcauccaggagguggaccgcacccucgccaaggaggggaucaagcggggcgagaccgaccaccacgccgucucccgcgggagcgccaagcugcggugguucguggagcgcaacauggugacgcccgagggcaaggucguggaccugggcugcgggcggggcgggugguccuacuacugcggcgggcucaagaacgugcgcgaggucaagggccugaccaagggcgggcccggccacgaggagcccaucccgaugagcaccuacggguggaaccuggugcggcuccaguccggcguggacgucuucuucaucccgcccgagaagugcgacacccugcugugcgacaucggggagagcucccccaacccgacgguggaggcgggccgcacccuccgggugcugaaccuggucgagaacuggcucaacaacaacacccaguucugcaucaaggugcugaaccccuacaugcccagcgugaucgagaagauggaggcccugcagcgcaaguacggcggggcccugguccggaacccgcucagccgcaacuccacccacgagauguacugggugagcaacgccuccggcaacaucgugagcuccgucaacaugaucagccggaugcugaucaaccgcuucaccaugcggcacaagaaggccacguacgagcccgacguggaccugggguccggcacccgcaacaucgggaucgagagcgagauccccaaccucgacaucaucggcaagcggaucgagaagaucaagcaggagcacgagaccuccuggcacuacgaccaggaccaccccuacaagaccugggcguaccacggcagcuacgagacgaagcagaccggguccgccagcuccauggugaacggcgucgugcgccugcugaccaagccgugggacgugcuccccaccgucacgcagauggccaugaccgacaccacccccuucgggcagcagcgcguguucaaggagaagguggacacgcggacccaggagcccaaggagggcaccaagaagcugaugaagaucaccgccgaguggcuguggaaggagcucggcaagaagaagacgccgcgcaugugcacccgggaggaguucacccgcaagguccggagcaacgccgcgcugggggccaucuucaccgacgagaacaaguggaaguccgcccgcgaggccguggaggacagccgguucugggagcuggucgacaaggagcgcaaccuccaccuggagggcaagugcgagacgugcguguacaacaugauggggaagcgggagaagaagcugggcgaguucgggaaggccaagggcucccgcgcgaucugguacauguggcucggcgcccgguuccuggaguucgaggcccugggguuccucaacgaggaccacugguucagccgcgagaacucccugagcggcguggagggggagggccugcacaagcuccgguacauccugcgcgacgucagcaagaaggagggcggggccauguacgcggacgacaccgccggcugggacacccggaucacccuggaggaccucaagaacgaggagauggugacgaaccacauggagggggagcacaagaagcuggccgaggccaucuucaagcugaccuaccagaacaaggugguccgcgugcagcggcccacgccccgcggcaccgugauggacaucaucucccggcgcgaccagcgggggagcggccaggucgggaccuacggccucaacaccuucaccaacauggaggcccagcugauccgccagauggagggcgaggggguguucaagaacauccagcaccugaccgcgacggaggagaucgccgugcagaacuggcucgcccgcgucggccgggagcgccugucccggauggccaucagcggggacgacugcguggugaagccccuggacgaccgcuucgccuccgcgcucaccgcccugaacgacaugggcaagauccggaaggacauccagcagugggagccgagccgcggcuggaacgacuggacccagguccccuucugcucccaccacuuccacgagcugaucaugaaggacgggcgggugcucgugguccccugccgcaaccaggacgagcugaucggccgggcccgcaucagccagggggccggcuggucccugcgggagaccgccugccucggcaagagcuacgcgcagauguggucccugauguacuuccaccgccgggaccugcgccucgccgccaacgccaucugcagcgccgugcccucccacugggugccgacgagccggaccaccugguccauccacgcgaagcacgaguggaugaccaccgaggacaugcugacggucuggaaccgcguguggauccaggagaaccccuggauggaggacaagacccccguggagagcugggaggagauccccuaccugggcaagcgggaggaccaguggugcggcucccucaucgggcugaccagccgcgccaccugggccaagaacauccaggccgcgaucaaccagguccggagccugaucggcaacgaggaguacacggacuacaugccguccaugaagcgcuuccgccgggaggaggaggaggccggggugcucugguga

SEQ ID NO: 9806 - RNA, 9876 nt, Artificial Sequence
  derived and/or modified CDS sequence (opt1) from DENV-2__AF169683__SS-prME
agcgcggggaugaucaucaugcugauccccaccgugauggccuuccaccucaccacccggaacggggagccccacaugaucgucagcauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacuccaccagcaccugggugaccuacgggaccugcaccaccaccggcgagcaccgccgggagaagcgcuccgucgcccuggugccccacgugggcauggggcucgagacgcggaccgagaccuggaugagcuccgagggcgccuggaagcacgcccagcgcaucgagaccuggauccugcggcacccgggguucacgaucauggccgcgauccuggccuacaccaucggcaccacccacuuccagcgcgcccucaucuucauccugcugacggccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugccccacccagggggagcccagccugaaggaggagcaggacaagcgguucgucugcaagcacuccaugguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcaucaccgaggccgagcugaccggcuacgggaccgugacgauggagugcagcccccggaccggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugacguucaagaacccccacgcgaagaagcaggacgucgugguccucggcagccaggagggggccaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggugaaggagaucgccgagacccagcacggcaccaucgucauccgggugcaguacgagggggacggcucccccugccgcauccccuucgagaucauggaccuggagaagcgguacgugcucggccgccugaucacggucaacccgaucgugaccgagaaggacagccccgugaacaucgaggcggagccgcccuucggggacuccuacaucaucaucggcgucgagccggggcagcugaagcucaacugguucaagaagggcagcuccaucgggcagauguucgagaccaccaugcgcggcgccaagcggauggccauccugggcgacacggccugggacuucgggagccugggcgggguguucaccuccaucggcaaggcccuccaccagguguucggggcgaucuacggcgccgccuucagcggcgucuccuggaccaugaagauccugaucggggugaucaucaccuggaucggcaugaacagccgcuccacgagccuguccgugagccugguccucguggggaucgugacccuguaccugggcgucauggugcaggccgacuccgggugcguggucagcuggaagaacaaggagcucaagugcggcagcggcaucuucaucaccgacaacgugcacaccuggacggagcaguacaaguuccagcccgagucccccagcaagcuggcguccgccauccagaaggcccaggaggaggggaucugcggcauccggagcgugacccgccuggagaaccucauguggaagcagaucacccccgagcugaaccacauccuggccgagaacgaggucaagcucaccaucaugacgggggacaucaagggcaucaugcacgccgggaagcggucccugcgcccgcagcccaccgagcugaaguacagcuggaagaccuggggcaaggcgaagaugcucuccaccgagagccacaaccagacguuccugaucgacggccccgagaccgccgagugcccgaacaccaaccgggccuggaacucccuggagguggaggacuacggguucggcguguucaccacgaacaucuggcucaagcugaaggagaagcaggacgccuucugcgacagcaagcugauguccgccgcgaucaaggacaaccgcgccguccacgccgacaugggguacuggaucgagagcgcccucaacgacaccuggaagaucgagaaggccuccuucaucgaggugaagaacugccacuggcccaagagccacacccugugguccaacggcgugcuggagagcgagaugaucauccccaagaaccucgcgggccccgucucccagcacaacuaccggccgggguaccacacccagaucgccggccccuggcaccuggggaagcuggagauggacuucgacuucugcgacggcaccacggugguggucaccgaggacugcgggaaccgcggccccagccuccggaccaccacggccagcggcaagcugaucaccgaguggugcugccgcuccugcacccugcccccgcuccgguaccgcggggaggacggcugcugguacgggauggagauccggccccugaaggagaaggaggagaaccuggugaacagccucgugaccgccggccacgggcaggucgacaacuucucccugggcgugcugggcauggcccucuuccuggaggagaugcugcgcacgcggguggggaccaagcacgccauccuccuggucgccgugagcuucgugacccugaucaccggcaacauguccuucaaggaccucgggcgcgucguggugauggucggcgccacgaugaccgacgacaucgggaugggcgugaccuaccuggcccugcucgcggccuucaaggugcggcccaccuucgccgccggccugcugcuccgcaagcugacgagcaaggagcugaugaugaccaccaucgggaucguccuccugucccagagcaccauccccgagacgauccuggagcucaccgacgcccuggcgcugggcaugauggugcucaagaucgugcgcaacauggagaaguaccagcuggccgucaccaucauggccauccugugcgugccgaacgccgucauccuccagaacgccuggaagguguccugcaccauccuggcgguggucagcgugagcccccugauccucacgagcucccagcagaagaccgacuggaucccccuggcccugaccaucaaggggcucaaccccaccgccaucuuccugacgacccugagccggaccaacaagaagcgcuccuggccgcucaacgaggccaucauggcggugggcauggucagcauccuggccuccagccugcucaagaacgacauccccaugaccggcccccugguggccgggggccugcucacggugugcuacguccugaccgggcgguccgccgaccuggagcucgagcgcgccaccgacgugaagugggaggaccaggcggagaucagcggcagcucccccauccugagcaucaccaucuccgaggacgggagcauguccaucaagaacgaggaggaggagcagacgcugaccauccucauccggaccggccugcuggugaucagcggccucuucccggucuccauccccaucaccgccgccgccugguaccugugggaggugaagaagcagcgcgccggggugcugugggacguccccuccccgccgcccaugggcaaggcggagcucgaggacggggccuaccggaucaagcagaagggcauccugggguacucccagaucggcgccggcguguacaaggaggggaccuuccacacgauguggcacgugacccgcggcgccguccugaugcacaaggggaagcggaucgagcccagcugggccgacgugaagaaggaccucaucuccuacggcgggggcuggaagcuggagggcgaguggaaggagggggaggaggugcagguccuggcgcucgagcccggcaagaacccccgcgccgugcagaccaagcccgggcuguucaagaccaacacgggcaccaucggggccgugagccuggacuucucccccggcaccagcggcucccccaucaucgacaagaaggggaaggucgugggccucuacgggaacggcguggucacccggagcggcgccuacguguccgccaucgcgcagacggagaaguccaucgaggacaaccccgagaucgaggacgacaucuuccgcaagcggcgccugaccaucauggaccugcaccccggggccggcaagaccaagcgguaccugcccgccaucgugcgcgaggccaucaagcgggggcuccgcacccugauccuggcgccgacgcgggucguggccgccgagauggaggaggcccuccgcggccugcccauccgguaccagacccccgccauccgcgcggagcacaccgggcgcgagaucguggaccugaugugccacgccaccuucacgaugcggcuccugucccccguccgcgugccgaacuacaaccugaucaucauggacgaggcccacuucaccgaccccgccagcaucgccgcgcggggcuacaucagcacccgcguggagaugggcgaggccgccgggaucuucaugaccgccacgccgcccggcucccgggacccguucccccagagcaacgcccccaucaucgacgaggagcgcgagauccccgagcgguccuggaacagcgggcacgagugggucaccgacuucaagggcaagaccgugugguucgugccguccaucaaggcggggaacgacaucgccgccugccuccgcaagaacggcaagaaggucauccagcugagccggaagaccuucgacuccgaguacgugaagacgcgcaccaacgacugggacuucguggucaccaccgacaucagcgagaugggcgccaacuucaaggcggagcgggugaucgacccccgccggugcaugaagcccgugauccugacggacggggaggagcgcgucauccucgccggccccaugccggugacccacuucuccgccgcccagcggcgcgggcggaucggccgcaaccccaagaacgagaacgaccaguacaucuacaugggggagccccuggagaacgacgaggacugcgcccacuggaaggaggcgaagaugcugcucgacaacaucaacacccccgagggcaucaucccgagcauguucgagcccgagcgggagaagguggacgccaucgacggcgaguaccgccugcgcggggaggcccggaagaccuucgucgaccugaugcgccggggcgaccuccccguguggcuggccuacaagguggccgcggaggggaucaacuacgccgaccgccgguggugcuucgacggcaucaagaacaaccagauccuggaggagaacgucgagguggagaucuggacgaaggagggggagcgcaagaagcucaagccgcgguggcuggacgcccgcaucuacuccgacccccuggcccucaaggaguucaaggaguucgccgcgggccgcaagagccuggcccugaaccucaucaccgagaugggccgccugcccaccuucaugacccagaagacgcgggacgcccuggacaaccucgccguccugcacaccgcggaggccgggggccgcgccuacaaccacgcccuguccgagcuccccgagacccuggagacccugcuccugcugacgcuccuggccaccgugaccgggggcaucuuccuguuccucaugagcggccgggggaucggcaagaugacccuggggaugugcugcaucaucaccgcguccauccugcucugguacgcccagauccagccgcacuggaucgccgccagcaucauccugguguucuuccugaucguccuccugauccccgagcccgagaagcagcgcacgccccaggacaaccagcugaccuacguggugaucgccauccucaccgucguggcggccaccauggccaacgagaugggcuuccuggagaagacgaagaaggaccugggguucggcuccaucgccacccagcagccggagagcaacauccucgacaucgaccugcggcccgccuccgcguggacccuguacgccguggccaccacguucgucacccccaugcuccgccacagcaucgagaacagcuccgugaacgugagccugaccgccaucgccaaccaggcgaccguccugaugggccucgggaagggcuggccccuguccaagauggacaucggggugccgcugcucgccaucggcugcuacagccaggugaaccccaucacgcugaccgccgcccugcuccugcuggucgcgcacuacgccaucaucgggcccggccuccaggccaaggccacccgggaggcccagaagcgcgcggccgccggcaucaugaagaaccccaccguggacgggaucacggugaucgaccuggacccgauccccuacgaccccaaguucgagaagcagcugggccaggucaugcuccuggugcugugcgugacccagguccucaugaugcggaccaccugggcccugugcgaggcccugacgcucgcgaccgggcccaucuccacccugugggagggcaacccggggcgcuucuggaacaccacgaucgccgugagcauggccaacaucuuccggggcuccuaccuggccggcgccgggcuccuguucagcaucaugaagaacaccaccaacacccgccgcggcacggggaacaucggcgagacccugggcgagaaguggaagucccggcucaacgcgcugggcaagagcgagucccagaucuacaagaaguccggcauccaggagguggaccgcacccuggccaaggaggggaucaagcggggcgagaccgaccaccacgccgucucccgcgggagcgccaagcuccggugguucguggagcgcaacauggugacgcccgagggcaaggucguggaccugggcugcgggcggggcgggugguccuacuacugcggcgggaucaagaacgugcgcgaggucaagggccugaccaagggcgggcccggccacgaggagcccaucccgaugagcaccuacggguggaaccucgugcggcugcaguccggcguggacgucuucuucaucccgcccgagaagugcgacacccugcucugcgacaucggggagagcucccccaacccgacgguggaggcgggccgcacccugcgggugcugaaccucgucgagaacuggcugaacaacaacacccaguucugcaucaaggugcugaaccccuacaugcccagcgugaucgagaagauggaggcccuccagcgcaaguacggcggggcccugguccggaacccgcugagccgcaacuccacccacgagauguacugggugagcaacgccuccggcaacaucgugagcuccgucaacaugaucagccggaugcugaucaaccgcuucaccaugcggcacaagaaggccacguacgagcccgacguggaccucggguccggcacccgcaacaucgggaucgagagcgagauccccaaccuggacaucaucggcaagcggaucgagaagaucaagcaggagcacgagaccuccuggcacuacgaccaggaccaccccuacaagaccugggcguaccacggcagcuacgagacgaagcagaccggguccgccagcuccauggugaacggcgucgugcgccugcucaccaagccgugggacgugcugcccaccgucacgcagauggccaugaccgacaccacccccuucgggcagcagcgcguguucaaggagaagguggacacgcggacccaggagcccaaggagggcaccaagaagcugaugaagaucaccgccgaguggcucuggaaggagcugggcaagaagaagacgccgcgcaugugcacccgggaggaguucacccgcaagguccggagcaacgccgcgcugggggccaucuucaccgacgagaacaaguggaaguccgcccgcgaggccguggaggacagccgguucugggagcucgucgacaaggagcgcaaccugcaccuggagggcaagugcgagacgugcguguacaacaugauggggaagcgggagaagaagcucggcgaguucgggaaggccaagggcucccgcgcgaucugguacauguggcugggcgcccgguuccuggaguucgaggcccucggguuccugaacgaggaccacugguucagccgcgagaacucccugagcggccucgagggggagggccugcacaagcugggguacauccuccgggacgugagcaagaaggagggcggcgccauguacgcggacgacaccgccgggugggacacccgcaucacccuggaggaccugaagaacgaggagauggucacgaaccacauggagggcgagcacaagaagcucgccgaggccaucuucaagcugaccuaccagaacaagguggugcggguccagcgccccacgccccgggggaccgugauggacaucaucucccgccgggaccagcgcggcagcggccaggugggcacguacggccugaacaccuucaccaacauggaggcccagcucauccggcagauggagggggagggcgucuucaagaacauccagcaccugaccgcgacggaggagaucgccgugcagaacuggcuggcccgcguggggcgcgagcggcucucccgcauggccaucagcggcgacgacugcgucgugaagccccuggacgaccgguucgccuccgcgcugaccgcccucaacgacaugggcaagauccgcaaggacauccagcagugggagccgagccggggguggaacgacuggacccaggugcccuucugcucccaccacuuccacgagcugaucaugaaggacggccgcguccugguggugcccugccggaaccaggacgagcucaucgggcgcgcccggaucagccagggcgccggguggucccugcgcgagaccgccugccugggcaagagcuacgcgcagauguggucccucauguacuuccaccggcgcgaccugcggcuggccgccaacgccaucugcagcgccguccccucccacugggugccgacgagccgcaccaccugguccauccacgcgaagcacgaguggaugaccaccgaggacaugcucacgguguggaaccgggucuggauccaggagaaccccuggauggaggacaagacccccguggagagcugggaggagauccccuaccugggcaagcgcgaggaccaguggugcgggucccugaucggccucaccagccgggccaccugggccaagaacauccaggccgcgaucaaccaggugcgcagccugaucgggaacgaggaguacacggacuacaugccguccaugaagcgguuccgccgcgaggaggaggaggccggcguccugugguga

SEQ ID NO: 9807 - RNA, 9876 nt, Artificial Sequence
  derived and/or modified CDS sequence (opt1) from DENV-2__AF169684__SS-prME
agcgccggcaugaucaucaugcugauccccaccgugauggccuuccaccucaccacccggaacggggagccccacaugaucgucagcauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacuccaccagcaccugggugaccuacgggaccugcaccaccaccggcgagcaccggcgggagaagcgguccgucgcccuggugccccacgugggcauggggcucgagacgcggaccgagaccuggaugagcuccgagggcgccuggaagcacgcccagcggaucgagaccuggauccugcggcacccgggguucacgaucauggccgcgauccuggccuacaccaucggcaccacccacuuccagcgggcccucaucuucauccugcugacggccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugccccacccagggggagcccagccugaaggaggagcaggacaagcgguucgucugcaagcacuccaugguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcaucaccgaggccgagcugaccggcuacgggaccgugacgauggagugcagcccccggaccggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugacguucaagaacccccacgcgaagaagcaggacgucgugguccucggcagccaggagggggccaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggugaaggagaucgccgagacccagcacggcaccaucgucauccgggugcaguacgagggggacggcucccccugccgcauccccuucgagaucauggaccuggagaagcgguacgugcucggccgccugaucacggucaacccgaucgugaccgagaaggacagccccgugaacaucgaggcggagccgcccuucggggacuccuacaucaucaucggcgucgagccggggcagcugaagcucaacugguucaagaagggcagcuccaucgggcagauguucgagaccaccaugcgcggcgccaagcggauggccauccugggcgacacggccugggacuucgggagccugggcgggguguucaccuccaucggcaaggcccuccaccagguguucggggcgaucuacggcgccgccuucagcggcgucuccuggaccaugaagauccugaucggggugaucaucaccuggaucggcaugaacagccgcuccacgagccuguccgugagccugguccucguggggaucgugacccuguaccugggcgucauggugcaggccgacuccgggugcguggucagcuggaagaacaaggagcucaagugcggcagcggcaucuucaucaccgacaacgugcacaccuggacggagcaguacaaguuccagcccgagucccccagcaagcuggcguccgccauccagaaggcccaggaggaggggaucugcggcauccggagcgugacccgccuggagaaccucauguggaagcagaucacccccgagcugaaccacauccuggccgagaacgaggucaagcucaccaucaugacgggggacaucaagggcaucaugcaggccgggaagcggucccugcgcccgcagcccaccgagcugaaguacagcuggaagaccuggggcaaggcgaagaugcucuccaccgagagccacaaccagacguuccugaucgacggccccgagaccgccgagugcccgaacaccaaccgggccuggaacucccuggagguggaggacuacggguucggcguguucaccacgaacaucuggcucaagcugaaggagaagcaggacgccuucugcgacagcaagcugauguccgccgcgaucaaggacaaccgcgccguccacgccgacaugggguacuggaucgagagcgcccucaacgacaccuggaagaucgagaaggccuccuucaucgaggugaagaacugccacuggcccaagagccacacccugugguccaacggcgugcuggagagcgagaugaucauccccaagaaccucgcgggccccgucucccagcacaacuaccggccgggguaccacacccagaucgccggccccuggcaccuggggaagcuggagauggacuucgacuucugcgacggcaccacggugguggucaccgaggacugcgggaaccgcggccccagccuccggaccaccacggccagcggcaagcugaucaccgaguggugcugccgcuccugcacccugcccccgcuccgguaccgcggggaggacggcugcugguacgggauggagauccggccccugaaggagaaggaggagaaccuggugaacagccucgugaccgccggccacgggcaggucgacaacuucucccugggcgugcugggcauggcccucuuccuggaggagaugcugcgcacgcggguggggaccaagcacgccauccuccuggucgccgugagcuucgugacccugaucaccggcaacauguccuucaaggaccucgggcgcgucguggugauggucggcgccacgaugaccgacgacaucgggaugggcgugaccuaccuggcccugcucgcggccuucaaggugcggcccaccuucgccgccggccugcugcuccgcaagcugacgagcaaggagcugaugaugaccaccaucgggaucguccuccugucccagagcaccauccccgagacgauccuggagcucaccgacgcccuggcgcugggcaugauggugcucaagaucgugcgcaacauggagaaguaccagcuggccgucaccaucauggccauccugugcgugccgaacgccgucauccuccagaacgccuggaagguguccugcaccauccuggcgguggucagcgugagcccccugauccucacgagcucccagcagaagaccgacuggaucccccuggcccugaccaucaaggggcucaaccccaccgccaucuuccugacgacccugagccggaccaacaagaagcgcuccuggccgcucaacgaggccaucauggcggugggcauggucagcauccuggccuccagccugcucaagaacgacauccccaugaccggcccccugguggccgggggccugcucacggugugcuacguccugaccgggcgguccgccgaccuggagcucgagcgcgccaccgacgugaagugggaggaccaggcggagaucagccggagcucccccauccugagcaucaccaucuccgaggacggcagcauguccaucaagaacgaggaggaggagcagacgcugaccauccucauccgcaccgggcugcuggugaucagcggccucuucccggucuccauccccaucaccgccgccgccugguaccugugggaggugaagaagcagcgggccggcgugcugugggacguccccuccccgccgcccauggggaaggcggagcucgaggacggcgccuaccgcaucaagcagaaggggauccugggcuacucccagaucggggccggcguguacaaggagggcaccuuccacacgauguggcacgugacccgcggggcgguccugaugcacaagggcaagcgcaucgagcccagcugggccgacgugaagaaggaccucaucuccuacgggggcggguggaagcuggagggcgaguggaaggagggcgaggaggugcagguccuggcgcucgagcccgggaagaacccccgggccgugcagaccaagcccggccuguucaagaccaacacggggaccaucggcgccgugagccuggacuucucccccgggaccagcggcucccccaucaucgacaagaagggcaaggucguggggcucuacggcaacgggguggucacccgcagcggcgccuacguguccgccaucgcgcagacggagaaguccaucgaggacaaccccgagaucgaggacgacaucuuccggaagcgccggcugaccaucauggaccugcaccccggcgccgggaagaccaagaaguaccugcccgccaucgugcgcgaggccaucaagcggggccuccgcacccugauccuggcgccgacgcgggucguggccgccgagauggaggaggcccuccgcgggcugcccauccgguaccagacccccgccauccgcgcggagcacaccggccgcgagaucguggaccugaugugccacgccaccuucacgaugcggcuccugucccccguccgcgugccgaacuacaaccugaucaucauggacgaggcccacuucaccgaccccgccagcaucgccgcgcggggguacaucagcacccgcguggagaugggcgaggccgccggcaucuucaugaccgccacgccgcccgggucccgggacccguucccccagagcaacgcccccaucaucgacgaggagcgcgagauccccgagcgguccuggaacagcggccacgagugggucaccgacuucaaggggaagaccgugugguucgugccguccaucaaggcgggcaacgacaucgccgccugccuccgcaagaacgggaagaaggucauccagcugagccggaagaccuucgacuccgaguacgugaagacgcgcaccaacgacugggacuucguggucaccaccgacaucagcgagaugggcgccaacuucaaggcggagcgggugaucgacccccgccggugcaugaagcccgugauccugacggacggcgaggagcgcgucauccucgccgggcccaugccggugacccacuucuccgccgcccagcggcgcggccggaucgggcgcaaccccaagaacgagaacgaccaguacaucuacaugggcgagccccuggagaacgacgaggacugcgcccacuggaaggaggcgaagaugcugcucgacaacaucaacacccccgaggggaucaucccgagcauguucgagcccgagcgggagaagguggacgccaucgacggcgaguaccgccugcgcggcgaggcccggaagaccuucgucgaccugaugcgccgcggggaccuccccguguggcuggccuacaagguggccgcggagggcaucaacuacgccgaccgccgguggugcuucgacgggaucaagaacaaccagauccuggaggagaacgucgagguggagaucuggacgaaggagggcgagcgcaagaagcucaagccgcgguggcuggacgcccgcaucuacuccgacccccuggcccucaaggaguucaaggaguucgccgcggggcgcaagagccuggcccugaaccucaucaccgagaugggccgccugcccaccuucaugacccagaagacgcgggacgcccuggacaaccucgccguccugcacaccgcggaggccggcgggcgcgccuacaaccacgcccuguccgagcuccccgagacccuggagacccugcuccugcugacgcuccuggccaccgugaccggcgggaucuuccuguuccucaugagcggccggggcaucgggaagaugacccugggcaugugcugcaucaucaccgcguccauccugcucugguacgcccagauccagccgcacuggaucgccgccagcaucauccuggaguucuuccugaucuuccuccugauccccgagcccgagaagcagcgcacgccccaggacaaccagcugaccuacguggucaucgccauccucaccgugguggcggccaccauggccaacgagaugggguuccuggagaagacgaagaaggaccugggcuucggguccaucgccacccagcagccggagagcaacauccucgacaucgaccugcggcccgccuccgcguggacccuguacgccgucgccaccacguucgugacccccaugcuccgccacagcaucgagaacagcuccgugaacgucagccugaccgccaucgccaaccaggcgaccgugcugaugggccucggcaagggguggccccuguccaagauggacaucggcgugccgcugcucgccaucgggugcuacagccaggucaaccccaucacgcugaccgccgcccugcuccugcugguggcgcacuacgccaucaucggccccgggcuccaggccaaggccacccgggaggcccagaagcgcgcggccgccggcaucaugaagaaccccaccguggacggcaucacggucaucgaccuggacccgauccccuacgaccccaaguucgagaagcagcugggccaggugaugcuccuggugcugugcgucacccaggugcucaugaugcggaccaccugggcccugugcgaggcccugacgcucgcgaccggccccaucuccacccugugggaggggaacccgggccgcuucuggaacaccacgaucgccgugagcauggccaacaucuuccggggguccuaccuggccggcgccggccuccuguucagcaucaugaagaacaccaccaacacccgccgcgggacgggcaacaucggggagacccugggcgagaaguggaagucccggcucaacgcgcugggcaagagcgaguuccagaucuacaagaaguccgggauccaggaggucgaccgcacccuggccaaggagggcaucaagcgcggggagaccgaccaccacgccgugagccgcggcuccgccaagcuccggugguucguggagcgcaacauggucacgcccgaggggaaggugguggaccugggcugcggccgcggcggguggagcuacuacugcggcgggcugaagaacguccgcgaggugaaggggcucaccaagggcgggcccgggcacgaggagcccaucccgauguccaccuacggcuggaaccuggugcggcugcagagcggggucgacguguucuucaucccgcccgagaagugcgacacccuccugugcgacaucggcgaguccagccccaacccgacgguggaggcggggcgcacccugcggguccucaaccugguggagaacuggcugaacaacaacacccaguucugcaucaaggugcucaaccccuacaugcccuccgucaucgagaagauggaggcccugcagcgccgguacggcggcgcccuggugcgcaacccgcugagccggaacagcacccacgagauguacuggguguccaacgccagcgggaacaucgucuccagcgugaacaugaucucccgcaugcucaucaaccgguucaccaugaagcacaagaaggccacguacgagcccgacguggaccugggcagcgggacccgcaacaucggcaucgaguccgagguccccaaccuggacaucaucgggaagcggaucgagaagaucaagcaggagcacgagaccagcuggcacuacgaccaggaccaccccuacaagaccugggcguaccacggcuccuacgagacgaagcagaccggcagcgccuccagcauggugaacggggugguccgccuccugaccaagccgugggacgugcugcccaccgugacgcagauggccaugaccgacaccacccccuucggccagcagcgcgucuucaaggagaagguggacacgcggacccaggagcccaaggaggggaccaagaagcucaugaagaucaccgccgaguggcuguggaaggagcugggcaagaagaagacgccgcgcaugugcacccgggaggaguucacccgcaaggugcgguccaacgccgcgcucggcgccaucuucaccgacgagaacaaguggaaguccgcccgcgaggccgucgaggacucccgguucugggagcugguggacaaggagcgcaaccugcaccucgaggggaagugcgagacgugcgucuacaacaugaugggcaagcgggagaagaagcugggggaguucggcaaggccaaggggagccgcgcgaucugguacauguggcugggcgcccgguuccucgaguucgaggcccugggcuuccugaacgaggaccacugguucucccgcgagaacagccucuccgggguggagggcgaggggcugcacaagcugggcuacauccuccgggacgugagcaagaaggagggcggggccauguacgcggacgacaccgccggcugggacacccgcaucacccuggaggaccugaagaacgaggagauggucacgaaccacauggagggggagcacaagaagcucgccgaggccaucuucaagcugaccuaccagaacaagguggugcggguccagcgccccacgccccggggcaccgugauggacaucaucagccgccgggaccagcgcggguccggccagguggggacguacggccugaacaccuucaccaacauggaggcccagcucauccggcagauggagggcgagggggucuucaagaacauccagcaccugaccgcgacggaggagaucgccgugcagaacuggcuggcccgcgugggccgcgagcggcucagccgcauggccaucuccggggacgacugcgucgugaagccccuggacgaccgguucgccagcgcgcugaccgcccucaacgacaugggcaagauccgcaaggacauccagcagugggagccgucccggggcuggaacgacuggacccaggugcccuucugcagccaccacuuccacgagcugaucaugaaggacgggcgcguccugguggugcccugccggaaccaggacgagcucaucggccgcgcccggaucucccagggggccggcuggagccugcgcgagaccgccugccuggggaaguccuacgcgcagauguggagccucauguacuuccaccggcgcgaccugcggcuggccgccaacgccaucugcuccgccguccccagccacugggugccgacgucccgcaccaccuggagcauccacgcgaagcacgaguggaugaccaccgaggacaugcucacgguguggaaccgggucuggauccaggagaaccccuggauggaggacaagacccccguggaguccugggaggagauccccuaccugggcaagcgcgaggaccaguggugcggcagccugaucgggcucaccucccgggccaccugggccaagaacauccaggccgcgaucaaccaggugcgcagccugaucggcaacgaggaguacacggacuacaugccgagcaugaagcgguuccgccgcgaggaggaggaggccgggguccugugguga

SEQ ID NO: 9808 - RNA, 9876 nt, Artificial Sequence
  derived and/or modified CDS sequence (opt1) from DENV-2__AF169685__SS-prME
agcgcggggaugaucaucaugcugauccccaccgugauggccuuccaccucaccacccgcaacggggagccccacaugaucgucagcauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacuccaccagcaccugggugaccuacgggaccugcaccaccaccggcgagcaccgccgggagaagcgcuccgucgcccuggugccccacgugggcauggggcucgagacgcggaccgagaccuggaugagcuccgagggcgccuggaagcacgcccagcgcaucgagaccuggauccugcggcacccgggguucacgaucauggccgcgauccuggccuacaccaucggcaccacccacuuccagcgcgcccucaucuucauccugcugacggccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugccccacccagggggagcccagccugaaggaggagcaggacaagcgguucgucugcaagcacuccaugguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcaucaccgaggccgagcugaccggcuacgggaccgugacgauggagugcagcccccggaccggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugacguucaagaacccccacgcgaagaagcaggacgucgugguccucggcagccaggagggggccaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggugaaggagaucgccgagacccagcacggcaccaucgucauccgggugcaguacgagggggacggcucccccugccgcauccccuucgagaucauggaccuggagaagcgguacgugcucggccgccugaucacggucaacccgaucgugaccgagaaggacagccccgugaacaucgaggcggagccgcccuucggggacuccuacaucaucaucggcgucgagccggggcagcugaagcucaacugguucaagaagggcagcuccaucgggcagauguucgagaccaccaugcgcggcgccaagcggauggccauccugggcgacacggccugggacuucgggagccugggcgggguguucaccuccaucggcaaggcccuccaccagguguucggggcgaucuacggcgccgccuucagcggcgucuccuggaccaugaagauccugaucggggugaucaucaccuggaucggcaugaacagccgcuccacgagccuguccgugagccugguccucguggggaucgugacccuguaccugggcgucauggugcaggccgacuccgggugcguggucagcuggaagaacaaggagcucaagugcggcagcggcaucuucaucaccgacaacgugcacaccuggacggagcaguacaaguuccagcccgagucccccagcaagcuggcguccgccauccagaaggcccaggaggaggggaucugcggcauccggagcgugacccgccuggagaaccucauguggaagcagaucacccccgagcugaaccacauccuggccgagaacgaggucaagcucaccaucaugacgggggacaucaagggcaucaugcaggccgggaagcggucccugcgcccgcagcccaccgagcugaaguacagcuggaagaccuggggcaaggcgaagaugcucuccaccgagagccacaaccagacguuccugaucgacggccccgagaccgccgagugcccgaacaccaaccgggccuggaacucccuggagguggaggacuacggguucggcguguucaccacgaacaucuggcucaagcugaaggagaagcaggacgccuucugcgacagcaagcugauguccgccgcgaucaaggacaaccgcgccguccacgccgacaugggguacuggaucgagagcgcccucaacgacaccuggaagaucgagaaggccuccuucaucgaggugaagaacugccacuggcccaagagccacacccugugguccaacggcgugcuggagagcgagaugaucauccccaagaaccucgcgggccccgucucccagcacaacuaccggccgggguaccacacccagaucgccggccccuggcaccuggggaagcuggagauggacuucgacuucugcgacggcaccacggugguggucaccgaggacugcgggaaccgcggccccagccuccggaccaccacggccagcggcaagcugaucaccgaguggugcugccgcuccugcacccugcccccgcuccgguaccgcggggaggacggcugcugguacgggauggagauccggccccugaaggagaaggaggagaaccuggugaacagccucgugaccgccggccacgggcaggucgacaacuucucccugggcgugcugggcauggcccucuuccuggaggagaugcugcgcacgcggguggggaccaagcacgccauccuccuggucgccgugagcuucgugacccugaucaccggcaacauguccuucaaggaccucgggcgcgucguggugauggucggcgccacgaugaccgacgacaucgggaugggcgugaccuaccuggcccugcucgcggccuucaaggugcggcccaccuucgccgccggccugcugcuccgcaagcugacgagcaaggagcugaugaugaccaccaucgggaucguccuccugucccagagcaccauccccgagacgauccuggagcucaccgacgcccuggcgcugggcaugauggugcucaagaucgugcgcaacauggagaaguaccagcuggccgucaccaucauggccauccugugcgugccgaacgccgucauccuccagaacgccuggaagguguccugcaccauccuggcgguggucagcgugagcccccugauccucacgagcucccagcagaagaccgacuggaucccccuggcccugaccaucaaggggcucaaccccaccgccaucuuccugacgacccugagccggaccaacaagaagcgcuccuggccgcucaacgaggccaucauggcggugggcauggucagcauccuggccuccagccugcucaagaacgacauccccaugaccggcccccugguggccgggggccugcucacggugugcuacguccugaccgggcgguccgccgaccuggagcucgagcgcgccaccgacgugaagugggaggaccaggcggagaucagcggcagcucccccauccugagcaucaccaucuccgaggacgggagcauguccaucaagaacgaggaggaggagcagacgcugaccauccucauccggaccggccugcuggugaucagcggccucuucccggucuccauccccaucaccgccgccgccugguaccugugggaggugaagaagcagcgcgccggggugcugugggacguccccuccccgccgcccaugggcaaggcggagcucgaggacggggccuaccggaucaagcagaagggcauccugggguacucccagaucggcgccggcguguacaaggaggggaccuuccacacgauguggcacgugacccgcggcgccguccugaugcacaaggggaagcggaucgagcccagcugggccgacgugaagaaggaccucaucuccuacggcgggggcuggaagcuggagggcgaguggaaggagggggaggaggugcagguccuggcgcucgagcccggcaagaacccccgcgccgugcagaccaagcccgggcuguucaagaccaacacgggcaccaucggggccgugagccuggacuucucccccggcaccagcggcucccccaucaucgacaagaaggggaaggucgugggccucuacgggaacggcguggucacccggagcggcgccuacguguccgccaucgcgcagacggagaaguccaucgaggacaaccccgagaucgaggacgacaucuuccgcaagcggcgccugaccaucauggaccugcaccccggggccggcaagaccaagcgguaccugcccgccaucgugcgcgaggccaucaagcgggggcuccgcacccugauccuggcgccgacgcgggucguggccgccgagauggaggaggcccuccgcggccugcccauccgguaccagacccccgccauccgcgcggagcacaccgggcgcgagaucguggaccugaugugccacgccaccuucacgaugcggcuccugucccccguccgcgugccgaacuacaaccugaucaucauggacgaggcccacuucaccgaccccgccagcaucgccgcgcggggcuacaucagcacccgcguggagaugggcgaggccgccgggaucuucaugaccgccacgccgcccggcucccgggacccguucccccagagcaacgcccccaucaucgacgaggagcgcgagauccccgagcgguccuggaacagcgggcacgagugggucaccgacuucaagggcaagaccgugugguucgugccguccaucaaggcggggaacgacaucgccgccugccuccgcaagaacggcaagaaggucauccagcugagccggaagaccuucgacuccgaguacgugaagacgcgcaccaacgacugggacuucguggucaccaccgacaucagcgagaugggcgccaacuucaaggcggagcgggugaucgacccccgccggugcaugaagcccgugauccugacggacggggaggagcgcgucauccucgccggccccaugccggugacccacuucuccgccgcccagcggcgcgggcggaucggccgcaaccccaagaacgagaacgaccaguacaucuacaugggggagccccuggagaacgacgaggacugcgcccacuggaaggaggcgaagaugcugcucgacaacaucaacacccccgagggcaucaucccgagcauguucgagcccgagcgggagaagguggacgccaucgacggcgaguaccgccugcgcggggaggcccggaagaccuucgucgaccugaugcgccggggcgaccuccccguguggcuggccuacaagguggccgcggaggggaucaacuacgccgaccgccgguggugcuucgacggcaucaagaacaaccagauccuggaggagaacgucgagguggagaucuggacgaaggagggggagcgcaagaagcucaagccgcgguggcuggacgcccgcaucuacuccgacccccuggcccucaaggaguucaaggaguucgccgcgggccgcaagagccuggcccugaaccucaucaccgagaugggccgccugcccaccuucaugacccagaagacgcgggacgcccuggacaaccucgccguccugcacaccgcggaggccgggggccgcgccuacaaccacgcccuguccgagcuccccgagacccuggagacccugcuccugcugacgcuccuggccaccgugaccgggggcaucuuccuguuccucaugagcggccgggggaucggcaagaugacccuggggaugugcugcaucaucaccgcguccauccugcucugguacgcccagauccagccgcacuggaucgccgccagcaucauccugguguucuuccugaucguccuccugauccccgagcccgagaagcagcgcacgccccaggacaaccagcugaccuacguggugaucgccauccucaccgucguggcggccaccauggccaacgagaugggcuuccuggagaagacgaagaaggaccugggguucggcuccaucgccacccagcagccggagagcaacauccucgacaucgaccugcggcccgccuccgcguggacccuguacgccguggccaccacguucgucacccccaugcuccgccacagcaucgagaacagcuccgugaacgugagccugaccgccaucgccaaccaggcgaccguccugaugggccucgggaagggcuggccccuguccaagauggacaucggggugccgcugcucgccaucggcugcuacagccaggugaaccccaucacgcugaccgccgcccugcuccugcuggucgcgcacuacgccaucaucgggcccggccuccaggccaaggccacccgggaggcccagaagcgcgcggccgccggcaucaugaagaaccccaccguggacgggaucacggugaucgaccuggacccgauccccuacgaccccaaguucgagaagcagcugggccaggucaugcuccuggugcugugcgugacccagguccucaugaugcggaccaccugggcccugugcgaggcccugacgcucgcgaccgggcccaucuccacccugugggagggcaacccggggcgcuucuggaacaccacgaucgccgugagcauggccaacaucuuccggggcuccuaccuggccggcgccgggcuccuguucagcaucaugaagaacaccaccaacacccgccgcggcacggggaacaucggcgagacccugggcgagaaguggaagucccggcucaacgcgcugggcaagagcgaguuccagaucuacaagaaguccggcauccaggagguggaccgcacccuggccaaggaggggaucaagcggggcgagaccgaccaccacgccgucagccgcggguccgccaagcuccggugguucguggagcgcaacauggugacgcccgagggcaaggucguggaccugggcugcgggcggggcggguggagcuacuacugcggcgggcugaagaacgugcgcgaggucaagggccucaccaagggcgggcccggccacgaggagcccaucccgauguccaccuacggguggaaccuggugcggcugcagagcggcguggacgucuucuucaucccgcccgagaagugcgacacccuccugugcgacaucggggaguccagccccaacccgacgguggaggcgggccgcacccugcgggugcucaaccuggucgagaacuggcugaacaacaacacccaguucugcaucaaggugcucaaccccuacaugcccuccgugaucgagaagauggaggcccugcagcgccgguacggcggggcccugguccgcaacccgcugagccggaacagcacccacgagauguacuggguguccaacgccagcggcaacaucguguccagcgucaacaugaucucccgcaugcucaucaaccgguucaccaugcgccacaagaaggccacguacgagcccgacguggaccuggggagcggcacccggaacaucgggaucgaguccgaggugcccaaccuggacaucaucggcaagcgcaucgagaagaucaagcaggagcacgagaccagcuggcacuacgaccaggaccaccccuacaagaccugggcguaccacggcuccuacgagacgaagcagaccgggagcgccuccagcauggucaacggcguggugcgccuccugaccaagccgugggacguccugcccaccgugacgcagauggccaugaccgacaccacccccuucgggcagcagcggguguucaaggagaaggucgacacgcgcacccaggagcccaaggagggcaccaagaagcucaugaagaucaccgccgaguggcuguggaaggagcugggcaagaagaagacgccgcggaugugcacccgcgaggaguucacccggaaggugcgcuccaacgccgcgcucggggccaucuucaccgacgagaacaaguggaaguccgcccgggaggccgucgaggacucccgcuucugggagcugguggacaaggagcggaaccugcaccucgagggcaagugcgagacgugcguguacaacaugauggggaagcgcgagaagaagcugggcgaguucgggaaggccaagggcagccgggcgaucugguacauguggcugggcgcccgcuuccucgaguucgaggcccugggguuccugaacgaggaccacugguucucccgggagaacagccucuccggcgucgagggggagggccugcacaagcugggguacauccuccgcgacgugagcaagaaggagggcggcgccauguacgcggacgacaccgccgggugggacacccggaucacccuggaggaccugaagaacgaggagauggugacgaaccacauggagggcgagcacaagaagcucgccgaggccaucuucaagcugaccuaccagaacaaggucgugcgcgugcagcggcccacgccccgggggaccgucauggacaucaucagccggcgcgaccagcggggcuccggccaggugggcacguacggccugaacaccuucaccaacauggaggcccagcucauccgccagauggagggggagggcguguucaagaacauccagcaccugaccgcgacggaggagaucgccguccagaacuggcuggcccgcguggggcgggagcgccucagccggauggccaucuccggcgacgacugcguggucaagccccuggacgaccgcuucgccagcgcgcugaccgcccucaacgacaugggcaagauccggaaggacauccagcagugggagccgucccgcggguggaacgacuggacccaggugcccuucugcagccaccacuuccacgagcugaucaugaaggacggccgggugcuggucgugcccugccgcaaccaggacgagcucaucgggcgggcccgcaucucccagggcgccggguggagccugcgggagaccgccugccugggcaaguccuacgcgcagauguggagccucauguacuuccaccgccgggaccugcgccuggccgccaacgccaucugcuccgccgugcccagccacugggucccgacgucccggaccaccuggagcauccacgcgaagcacgaguggaugaccaccgaggacaugcucacgguguggaaccgcguguggauccaggagaaccccuggauggaggacaagacccccgucgaguccugggaggagauccccuaccugggcaagcgggaggaccaguggugcgggagccugaucggccucaccucccgcgccaccugggccaagaacauccaggccgcgaucaaccaggugcggagccugaucgggaacgaggaguacacggacuacaugccgagcaugaagcgcuuccgccgggaggaggaggaggccggcgugcugugguga

SEQ ID NO: 9809 - RNA, 9876 nt, Artificial Sequence
  derived and/or modified CDS sequence (opt1) from DENV-2__AF169686__SS-prME
agcgccgggaugaucaucaugcugauccccaccgugauggccuuccaccucaccacccgcaacggggagccccacaugaucgucagcauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacuccaccagcaccugggugaccuacgggacgugcaccaccaccggcgagcaccgccgggagaagcgcuccgucgcccuggugccccacgugggcauggggcucgagacgcggaccgagaccuggaugagcuccgagggcgccuggaagcacgcccagcgcaucgagaccuggauccugcggcaccccggguucacgaucauggccgcgauccuggccuacaccaucggcaccacccacuuccagcgcgcccucaucuucauccugcugacggccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugcccgacccagggggagcccagccugaaggaggagcaggacaagcgguucgucugcaagcacuccaugguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcaucaccgaggccgagcugaccggcuacgggaccgugacgauggagugcagcccccggaccggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugacguucaagaacccccacgcgaagaagcaggacgucgugguccucggcagccaggagggggccaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggugaaggagaucgccgagacccagcacggcaccaucgucauccgggugcaguacgagggggacggcucccccugccgcauccccuucgagaucauggaccuggagaagcgguacgugcucggccgccugaucacggucaacccgaucgugaccgagaaggacagccccgugaacaucgaggcggagccgcccuucggggacuccuacaucaucaucggcgucgagccggggcagcugaagcucaacugguucaagaagggcagcuccaucgggcagauguucgagaccaccaugcgcggcgccaagcggauggccauccugggcgacacggccugggacuucgggagccugggcgggguguucaccuccaucggcaaggcccuccaccagguguucggggcgaucuacggcgccgccuucagcggcgucuccuggaccaugaagaucuucaucggggugaucaucaccuggaucggcaugaacagccgcuccacgagccuguccgugagccugguccugguggggaucgugacccucuaccugggcgucauggugcaggccgacuccgggugcguggucagcuggaagaacaaggagcugaagugcggcagcggcaucuucaucaccgacaacgugcacaccuggacggagcaguacaaguuccagcccgagucccccagcaagcucgcguccgccauccagaaggcccaggaggaggggaucugcggcauccggagcgugacccgccuggagaaccugauguggaagcagaucacccccgagcucaaccacauccuggccgagaacgaggucaagcugaccaucaugacgggggacaucaagggcaucaugcaggccgggaagcggucccuccgcccgcagcccaccgagcugaaguacagcuggaagaccuggggcaaggcgaagaugcuguccaccgagagccacaaccagacguuccucaucgacggccccgagaccgccgagugcccgaacaccaaccgggccuggaacucccuggagguggaggacuacggguucggcguguucaccacgaacaucuggcugaagcucaaggagaagcaggacgccuucugcgacagcaagcugauguccgccgcgaucaaggacaaccgcgccguccacgccgacaugggguacuggaucgagagcgcccugaacgacaccuggaagaucgagaaggccuccuucaucgaggugaagaacugccacuggcccaagagccacacccucugguccaacggcgugcuggagagcgagaugaucauccccaagaaccuggcgggccccgucucccagcacaacuaccggccgggguaccacacccagaucgccggccccuggcaccucgggaagcuggagauggacuucgacuucugcgacggcaccacggugguggucaccgaggacugcgggaaccgcggccccagccugcggaccaccacggccagcggcaagcucaucaccgaguggugcugccgcuccugcacccugcccccgcugcgguaccgcggggaggacggcugcugguacgggauggagauccggccccucaaggagaaggaggagaaccuggugaacagccuggugaccgccggccacgggcaggucgacaacuucucccucggcgugcugggcauggcgcuguuccucgaggagaugcugcgcacgcggguggggaccaagcacgccauccugcucgucgccgugagcuucgugacccugaucaccggcaacauguccuucaaggaccuggggcgcgucguggugauggucggcgccacgaugaccgacgacaucgggaugggcgugaccuaccucgcccugcuggcggccuucaaggugcggcccaccuucgccgccggccuccugcugcgcaagcucacgagcaaggagcugaugaugaccaccaucgggaucguccugcucucccagagcaccauccccgagacgauccuggagcugaccgacgcccucgcgcugggcaugauggugcugaagaucgugcgcaacauggagaaguaccagcucgccgucaccaucauggccauccugugcgugccgaacgccgucauccugcagaacgccuggaagguguccugcaccauccucgcgguggucagcgugagcccccugauccugacgagcucccagcagaagaccgacuggaucccccucgcccugaccaucaaggggcugaaccccaccgccaucuuccucacgacccugagccggaccaacaagaagcgcuccuggccggugaacgaggccaucauggcggucggcauggugagcauccuggccuccagccuccugaagaacgacauccccaugaccggcccccugguggccgggggccuccugacggucugcuacgugcugaccgggcgguccgccgaccucgagcuggagcgcgccaccgacgugaagugggaggaccaggcggagaucagcggcagcucccccauccugagcaucaccaucuccgaggacgggagcauguccaucaagaacgaggaggaggagcagacgcucaccauccugauccggaccggccugcucgucaucagcggccuguucccgguguccauccccaucaccgccgccgccugguaccugugggaggugaagaagcagcgcgccgggguccucugggacgugcccuccccgccgcccaugggcaaggcggagcuggaggacggggccuaccggaucaagcagaagggcauccugggguacucccagaucggcgccggcguguacaaggaggggaccuuccacacgauguggcacgucacccgcggcgccgugcucaugcacaaggggaagcggaucgagcccagcugggccgacgugaagaaggaccugaucuccuacggcgggggcuggaagcuggagggcgaguggaaggagggggaggagguccaggugcucgcgcuggagcccggcaagaacccccgcgccgugcagaccaagcccgggcuguucaagaccaacacgggcaccaucggggccgucagccucgacuucucccccggcaccagcggcucccccaucaucgacaagaaggggaagguggugggccuguacgggaacggcgucgugacccggagcggcgccuacguguccgccaucgcgcagacggagaaguccaucgaggacaaccccgagaucgaggacgacaucuuccgcaagcggcgccugaccaucauggaccuccaccccggggccggcaagaccaagaaguaccugcccgccaucguccgggaggccaucaagcgcgggcugcggacccugauccucgcgccgacgcgcgugguggccgccgagauggaggaggcccugcggggccugcccauccgcuaccagacccccgccauccgggcggagcacaccgggcgcgagaucgucgaccucaugugccacgccaccuucacgaugcgccugcugucccccgugcgggugccgaacuacaaccucaucaucauggacgaggcccacuucaccgaccccgccagcaucgccgcgcgcggcuacaucagcacccgggucgagaugggcgaggccgccgggaucuucaugaccgccacgccgcccggcucccgcgacccguucccccagagcaacgcccccaucaucgacgaggagcgggagauccccgagcgcuccuggaacagcgggcacgagugggugaccgacuucaagggcaagaccgugugguucgucccguccaucaaggcggggaacgacaucgccgccugccugcggaagaacggcaagaaggugauccagcugagccgcaagaccuucgacuccgaguacgugaagacgcggaccaacgacugggacuucgucgugaccaccgacaucagcgagaugggcgccaacuucaaggcggagcgcgugaucgacccccggcgcugcaugaagcccgucauccucacggacggggaggagcgggugauccuggccggccccaugccggugacccacuucuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacccccgagggcaucaucccgagcauguucgagcccgagcgcgagaaggucgacgccaucgacggcgaguaccggcugcgcggggaggcccgcaagaccuucguggaccucaugcggcgcggcgaccugcccguguggcuggccuacaaggucgccgcggaggggaucaacuacgccgaccggcgcuggugcuucgacggcaucaagaacaaccagauccucgaggagaacguggaggucgagaucuggacgaaggagggggagcggaagaagcugaagccgcgcuggcuggacgcccggaucuacuccgacccccucgcccugaaggaguucaaggaguucgccgcgggccgcaagagccuggcccucaaccugaucaccgagaugggccggcugcccaccuucaugacccagaagacgcgcgacgcccucgacaaccuggccgugcugcacaccgcggaggccgggggccgggccuacaaccacgcccucuccgagcugcccgagacccuggagacccuccugcugcucacgcugcuggccaccgugaccgggggcaucuuccucuuccugaugagcggccgcgggaucggcaagaugacccuggggaugugcugcaucaucaccgcguccauccuccugugguacgcccagauccagccgcacuggaucgccgccagcaucauccuggucuucuuccucaucgugcugcugauccccgagcccgagaagcagcggacgccccaggacaaccagcucaccuacguggucaucgccauccugaccgugguggcggccaccauggccaacgagaugggcuuccuggagaagacgaagaaggaccucggguucggcuccaucgccacccagcagccggagagcaacauccuggacaucgaccugcgccccgccuccgcguggacccucuacgccgucgccaccacguucgugacccccaugcugcggcacagcaucgagaacagcuccgugaacgucagccugaccgccaucgccaaccaggcgaccgugcucaugggccuggggaagggcuggccccuguccaagauggacaucggggugccgcuccuggccaucggcugcuacagccaggucaaccccaucacgcugaccgccgcccuccugcugcucguggcgcacuacgccaucaucgggcccggccugcaggccaaggccacccgcgaggcccagaagcgggcggccgccggcaucaugaagaaccccaccguggacgggaucacggucaucgaccuggacccgauccccuacgaccccaaguucgagaagcagcucggccaggugaugcugcuggugcucugcgucacccaggugcugaugaugcgcaccaccugggcccugugcgaggcccucacgcuggcgaccgggcccaucuccacccugugggagggcaacccggggcgguucuggaacaccacgaucgccgugagcauggccaacaucuuccgcggcuccuaccucgccggcgccgggcugcuguucagcaucaugaagaacaccaccaacacccggcgcggcacggggaacaucggcgagacccucggcgagaaguggaagucccgccugaacgcgcugggcaagagcgaguuccagaucuacaagaaguccggcauccaggaggucgaccggacccucgccaaggaggggaucaagcgcggcgagaccgaccaccacgccgugagccggggguccgccaagcugcgcugguucguggagcggaacauggucacgcccgagggcaaggugguggaccugggcugcgggcgcggcggguggagcuacuacugcggcgggcucaagaacguccgggaggugaagggccugaccaagggcgggcccggccacgaggagcccaucccgauguccaccuacggguggaaccuggugcgccuccagagcggcgucgacguguucuucacgccgcccgagaagugcgacacgcugcugugcgacaucggggaguccagccccaacccgaccguggaggcgggccggacccuccgcguccugaaccugguggagaacuggcucaacaacaacacccaguucugcaucaaggugcugaaccccuacaugcccuccgucaucgagaagauggaggcccugcagcggcgcuacggcggggcccucgugcggaacccgcugagccgcaacagcacccacgagauguacuggguguccaacgccagcggcaacaucgucuccagcgugaacaugaucucccggaugcugaucaaccgcuucacgaugaagcacaagaaggccaccuacgagcccgacguggaccuggggagcggcacccggaacaucgggaucgaguccgagguccccaaccucgacaucaucggcaagcgcaucgagaagaucaagcaggagcacgagaccagcuggcacuacgaccaggaccaccccuacaagacgugggcguaccacggcuccuacgagaccaagcagaccgggagcgccuccagcauggugaacggcgugguccggcugcugaccaagccgugggacgugcuccccacggugacccagauggccaugaccgacaccacgcccuucgggcagcagcgcgucuucaaggagaagguggacacccgcacccaggagcccaaggagggcaccaagaagcugaugaagaucacggccgaguggcuguggaaggagcucggcaagaagaagaccccgcggaugugcacccgcgaggaguucacccggaagguccgcuccaacgccgcgcugggggccaucuucacggacgagaacaaguggaaguccgcccgggaggccguggaggacucccgcuucugggagcugguggacaaggagcggaaccuccaccuggagggcaagugcgagaccugcgucuacaacaugauggggaagcgcgagaagaagcugggcgaguucgggaaggccaagggcagccgggcgaucugguacauguggcucggcgcccgcuuccuggaguucgagacccugggguuccucaacgaggaccacugguucucccgggagaacagccuguccggcguggagggggagggccugcacaagcucggguacauccugcgcgacgugagcaagaaggagggcggcgccauguacgccgacgacaccgcggggugggacacgcggaucacccuggaggaccucaagaacgaggagauggucaccaaccacauggagggcgagcacaagaagcuggccgaggccaucuucaagcugaccuaccagaacaagguggugcgcguccagcggcccacgccccgcgggaccgugauggacaucaucagccggcgcgaccagcggggcuccggccaggugggcaccuacggccucaacaccuucacgaacauggaggcccagcugauccgccagauggagggggagggcgucuucaagaacauccagcaccugaccgccaccgaggagaucgcggugcagaacuggcucgcccggguggggcgcgagcgccugagccggauggccaucuccggcgacgacugcgucgugaagccccuggacgaccgcuucgccagcgcccucaccgcgcugaacgacaugggcaagauccggaaggacauccagcagugggagccgucccgcggguggaacgacuggacccaggugcccuucugcagccaccacuuccacgagcugaucaugaaggacggccggguccucguggugcccugccgcaaccaggacgagcugaucgggcgggcccgcaucucccagggcgccggguggagccugcgggagaccgccugccucggcaaguccuacgcccagauguggagccugauguacuuccaccgccgggaccugcgccucgcggccaacgccaucugcuccgccguccccagccacugggugccgaccucccggaccaccuggagcauccacgccaagcacgaguggaugacgaccgaggacaugcuggcgguguggaaccgcgucuggauccaggagaaccccuggauggaggacaagacccccguggaguccugggaggagauccccuaccugggcaagcgggaggaccaguggugcgggagccucaucggccugaccucccgcgccacgugggccaagaacauccaggccgcgaucaaccaggugcggagccugaucgggaacgaggaguacaccgacuacaugccgagcaugaagcgcuuccggcgcgaggaggaggaggccggcguccucugguga

SEQ ID NO: 9810 - RNA, 9876 nt, Artificial Sequence
  derived and/or modified CDS sequence (opt1) from DENV-2__AF169687__SS-prME
agcgcgggcaugaucaucaugcugauccccaccgugauggccuuccaccucaccacccgcaacggggagccccacaugaucgucagcauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacuccaccagcaccugggugaccuacgggaccugcaccaccaccggcgagcaccgccgggagaagcgcuccgucgcccuggugccccacgugggcauggggcucgagacccggaccgagaccuggaugagcuccgagggcgccuggaagcacgcccagcgcaucgagaccuggauccugcggcacccgggguucaccaucauggccgcgauccuggccuacaccaucggcaccacccacuuccagcgcgcccucaucuucauccugcugacggccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugccccacccagggggagcccagccugaaggaggagcaggacaagcgguucgucugcaagcacuccaugguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcaucaccgaggccgagcugaccggcuacgggaccgugacgauggagugcagcccccggaccggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugacguucaagaacccccacgcgaagaagcaggacgucgugguccucggcagccaggagggggccaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggugaaggagaucgccgagacccagcacggcaccaucgucauccgggugcaguacgagggggacggcucccccugccgcauccccuucgagaucauggaccuggagaagcgguacgugcucggccgccugaucacggucaacccgaucgugaccgagaaggacagccccgugaacaucgaggcggagccgcccuucggggacuccuacaucaucaucggcgucgagccggggcagcugaagcucaacugguucaagaagggcagcuccaucgggcagauguucgagaccaccaugcgcggcgccaagcggauggccauccugggcgacacggccugggacuucgggagccugggcgggguguucaccuccaucggcaaggcccuccaccagguguucggggcgaucuacggcgccgccuucagcggcgucuccuggaccaugaagauccugaucggggugaucaucaccuggaucggcaugaacagccgcuccacgagccuguccgugagccugguccucguggggaucgugacccuguaccugggcgucauggugcaggccgacuccgggugcguggucagcuggaagaacaaggagcucaagugcggcagcggcaucuucaucaccgacaacgugcacaccuggacggagcaguacaaguuccagcccgagucccccagcaagcuggcguccgccauccagaaggcccaggaggaggggaucugcggcauccggagcgugacccgccuggagaaccucauguggaagcagaucacccccgagcugaaccacauccuguccgagaacgaggucaagcucaccaucaugacgggggacaucaagggcaucaugcacgccgggaagcggagccugcgcccgcagcccaccgagcugaaguacuccuggaagaccuggggcaucgccaagaugcucagcaccgagucccacaaccagacguuccugaucgacggccccgagaccgcggagugcccgaacaccaaccgggccuggaacagccuggagguggaggacuacggguucggcguguucaccacgaacaucuggcucaagcugaaggagaagcaggacgccuucugcgacuccaagcugaugagcgccgccaucaaggacaaccgcgcgguccacgccgacaugggguacuggaucgaguccgcccucaacgacaccuggaagaucgagaaggccagcuucaucgaggugaagaacugccacuggcccaagucccacacccuguggagcaacggcgugcuggaguccgagaugaucauccccaagaaccucgccggccccgucagccagcacaacuaccggccgggguaccacacccagaucgcgggccccuggcaccuggggaagcuggagauggacuucgacuucugcgacggcaccacggugguggucaccgaggacugcgggaaccgcggccccagccuccggaccaccacggccuccggcaagcugaucaccgaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacgcggguggggaccaagcacgcgauccuccuggucgccguguccuucgugacccugaucaccggcaacaugagcuucaaggaccucgggcgcgucguggugacggucggcgccaccaugaccgacgacaucgggaugggcgugaccuaccuggcccugcucgccgcguucaaggugcggcccacguucgccgccggccugcugcuccgcaagcugaccuccaaggagcugaugaugaccaccaucgggaucguccuccugagccaguccacgauccccgagaccauccuggagcucaccgacgcccuggcccugggcaugauggugcucaagaucgugcgcaacauggagaaguaccagcuggcggucaccaucauggccauccugugcgugccgaacgccgucauccuccagaacgccuggaaggugagcugcacgauccuggccguggucuccgugagcccccugauccucaccuccagccagcagaagaccgacuggaucccccuggcgcugaccaucaaggggcucaaccccacggccaucuuccugaccacccugucccggaccaacaagaagcgcagcuggccgcucaacgaggccaucauggccgugggcauggucuccauccuggcgagcucccugcucaagaacgacauccccaugacgggcccccugguggccgggggccugcucaccgugugcuacguccugaccgggcggagcgccgaccuggagcucgagcgcgccaccgacgugaagugggaggaccaggccgagaucagcggcuccagccccauccuguccaucacgaucagcgaggacggguccaugagcaucaagaacgaggaggaggagcagacccugaccauccucauccggaccggccugcuggugaucuccggccucuucccggucagcauccccaucaccgcggccgccugguaccugugggaggugaagaagcagcgcgccggggugcugugggacguccccagcccgccgcccaugggcaaggccgagcucgaggacggggcguaccggaucaagcagaagggcauccugggguacagccagaucggcgccggcguguacaaggaggggacguuccacaccauguggcacgugacccgcggcgccguccugaugcacaaggggaagcggaucgagcccuccugggccgacgugaagaaggaccucaucagcuacggcgggggcuggaagcuggagggcgaguggaaggagggggaggaggugcagguccuggcccucgagcccggcaagaacccccgcgcggugcagaccaagcccgggcuguucaagacgaacaccggcaccaucggggccgugucccuggacuucagccccggcaccuccggcagccccaucaucgacaagaaggggaaggucgugggccucuacgggaacggcguggucacgcgguccggcgccuacgugagcgccaucgcccagaccgagaaguccaucgaggacaaccccgagaucgaggacgacaucuuccgcaagcggcgccugaccaucauggaccugcaccccggggcgggcaagaccaagcgguaccugcccgccaucgugcgcgaggccaucaagcgggggcuccgcacgcugauccuggccccgacccgggucguggcggccgagauggaggaggcccuccgcggccugcccauccgguaccagacccccgccauccgcgccgagcacaccgggcgcgagaucguggaccugaugugccacgcgacguucaccaugcggcuccugagccccguccgcgugccgaacuacaaccugaucaucauggacgaggcccacuucaccgaccccgccagcaucgccgcccggggcuacaucuccacccgcguggagaugggcgaggcggccgggaucuucaugacggccacgccgcccggcagccgggacccguucccccaguccaacgcccccaucaucgacgaggagcgcgagauccccgagcggagcuggaacuccgggcacgagugggucaccgacuucaagggcaagaccgugugguucgugccgagcaucaaggccgggaacgacaucgcggccugccuccgcaagaacggcaagaaggucauccagcugucccggaagacguucgacagcgaguacgugaagacccgcaccaacgacugggacuucguggucaccacggacaucuccgagaugggcgccaacuucaaggccgagcgggugaucgacccccgccggugcaugaagcccgugauccugaccgacggggaggagcgcgucauccucgcgggccccaugccggugacccacuucagcgccgcccagcggcgcgggcggaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccggaagacguucgucgaccugaugcgccggggcgaccuccccguguggcuggccuacaagguggccgccgaggggaucaacuacgcggaccgccgguggugcuucgacggcaucaagaacaaccagauccuggaggagaacgucgagguggagaucuggaccaaggagggggagcgcaagaagcucaagccgcgguggcuggacgcccgcaucuacagcgacccccuggcccucaaggaguucaaggaguucgccgccggccggaagucccuggcgcugaaccucaucaccgagaugggccgccugcccaccuucaugacgcagaagacccgggacgcccuggacaaccucgccguccugcacaccgccgaggccgggggccgcgccuacaaccacgcccugagcgagcuccccgagacccuggagacgcugcuccugcugacccuccuggccaccgugaccgggggcaucuuccuguuccucauguccggccgggggaucggcaagaugacccuggggaugugcugcaucaucacggccagcauccugcucugguacgcgcagauccagccgcacuggaucgccgccuccaucauccugguguucuuccugaucguccuccugauccccgagcccgagaagcagcgcacgccccaggacaaccagcugaccuacguggugaucgccauccucaccgucguggccgcgacgauggccaacgagaugggcuuccuggagaagaccaagaaggaccugggguucggcagcaucgccacccagcagccggaguccaacauccucgacaucgaccugcggcccgccagcgccuggacccuguacgcgguggccacgaccuucgucacccccaugcuccgccacagcaucgagaacuccagcgugaacgugucccugaccgccaucgccaaccaggccacgguccugaugggccucgggaagggcuggccccugagcaagauggacaucggggugccgcugcucgcgaucggcugcuacucccaggugaaccccaucacccugaccgccgcccugcuccugcuggucgcccacuacgcgaucaucgggcccggccuccaggccaaggccacccgggaggcccagaagcgcgccgcggccggcaucaugaagaaccccacgguggacgggaucaccgugaucgaccuggacccgauccccuacgaccccaaguucgagaagcagcugggccaggucaugcuccuggugcugugcgugacccagguccucaugaugcggaccacgugggcccugugcgaggcccugacccucgccaccgggcccaucagcacccugugggagggcaacccggggcgcuucuggaacacgaccaucgcgguguccauggccaacaucuuccggggcagcuaccuggccggcgccgggcuccuguucuccaucaugaagaacaccaccaacacgcgccgcggcaccgggaacaucggcgagacccugggcgagaaguggaagucccggcucaacgcccuggggaaguccgaguuccagaucuacaagaaguccggcauccaggagguggaccgcacccuggcgaaggaggggaucaagcggggcgagacggaccaccacgccgucucccgcgggagcgccaagcuccggugguucguggagcgcaacauggugacccccgagggcaaggucguggaccugggcuccgggcggggcggguggagcuacuacugcggcgggcugaagaacgugcgcgaggucaagggccucaccaagggcgggcccggccacgaggagcccaucccgauguccaccuacggguggaaccuggugcggcugcagagcggcguggacgucuucuucaucccgcccgagaagugcgacacgcuccugugcgacaucggggaguccagccccaacccgaccguggaggccggccgcacccugcgggugcucaaccuggucgagaacuggcugaacaacaacacccaguucugcaucaaggugcucaaccccuacaugcccagcgugaucgagaagauggaggcgcugcagcgcaaguacggcggggcccugguccggaacccgcugucccgcaacagcacccacgagauguacuggguguccaacgccagcggcaacaucguguccagcgucaacaugaucucccggaugcucaucaaccgcuucacgaugcggcacaagaaggccaccuacgagcccgacguggaccuggggagcggcacccgcaacaucgggaucgaguccgagauccccaaccuggacaucaucggcaagcggaucgagaagaucaagcaggagcacgagaccagcuggcacuacgaccaggaccaccccuacaagacgugggccuaccacggcuccuacgagaccaagcagaccgggagcgcguccagcauggugaacggcgucgugcgccuccugaccaagccgugggacgugcugcccacggucacccagauggccaugaccgacaccacgcccuucgggcagcagcgcguguucaaggagaagguggacacccggacccaggagcccaaggagggcaccaagaagcucaugaagaucacggccgaguggcuguggaaggagcugggcaagaagaagaccccgcgcaugugcacccgggaggaguucacccgcaagguccgguccaacgccgcccucggggcgaucuucacggacgagaacaaguggaaguccgcccgcgaggccguggaggacucccgguucugggagcuggucgacaaggagcgcaaccugcaccucgagggcaagugcgagaccugcguguacaacaugauggggaagcgggagaagaagcugggcgaguucgggaaggccaagggcagccgcgccaucugguacauguggcugggcgcgcgguuccucgaguucgaggcccugggguuccugaacgaggaccacugguucucccgcgagaacagccucagcggcguggagggggagggcucccacaagcugggguacauccugcgggacgucagcaagaaggagggcggcgccauguacgccgacgacaccgcggggugggacacccgcaucacgcucgaggaccugaagaacgaggagauggugaccaaccacauggagggcgagcacaagaagcuggccgaggccaucuucaagcucaccuaccagaacaaggugguccgggugcagcgccccacgccccgggggacggugauggacaucaucucccgccgggaccagcgcggcagcgggcaggucggcaccuacggccugaacaccuucaccaacauggaggcccagcugauccggcagauggagggggagggcguguucaagaacauccagcaccucacggccaccgaggagaucgcggugcagaacuggcuggcccgcgucgggcgcgagcggcugucccgcauggccaucagcggcgacgacugcguggugaagccccucgacgaccgguucgccuccgcccugaccgcgcugaacgacaugggcaagauccgcaaggacauccagcagugggagccgagccggggguggaacgacuggacccagguccccuucugcucccaccacuuccacgagcucaucaugaaggacggccgcgugcuggugguccccugccggaaccaggacgagcugaucgggcgcgcccggaucagccagggcgccggguggucccuccgcgagacggccugccugggcaagagcuacgcccagauguggucccugauguacuuccaccggcgcgaccuccggcuggcggccaacgccaucugcagcgccgugcccucccacugggugccgaccagccgcaccaccugguccauccacgccaagcacgaguggaugaccacggaggacaugcugaccgucuggaaccggguguggauccaggagaaccccuggauggaggacaagacccccguggagagcugggaggagauccccuaccucggcaagcgcgaggaccaguggugcgggagccugaucggccugaccucccgggcgacgugggccaagaacauccaggccgccaucaaccagguccgcagccucaucgggaacgaggaguacaccgacuacaugccguccaugaagcgguuccgccgcgaggaggaggaggcgggcgugcugugguga

SEQ ID NO: 9811 - RNA, 9876 nt, Artificial Sequence
  derived and/or modified CDS sequence (opt1) from DENV-2__AF169688__SS-prME
agcgcgggcaugaucaucaugcugauccccaccgugauggccuuccaccucaccacccggaacggggagccccacaugaucgucagcauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacuccaccagcaccugggugaccuacgggaccugcaccaccaccggcgagcaccgccgggagaagcgcuccgucgcccuggugccccacgugggcauggggcucgagacccggaccgagaccuggaugagcuccgagggcgccuggaagcacgcccagcgcaucgagaccuggauccugcggcacccgggguucaccaucauggccgcgauccuggccuacaccaucggcaccacccacuuccagcgcgcccucaucuucauccugcugacggccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugccccacccagggggagcccagccugaaggaggagcaggacaagcgguucgucugcaagcacuccaugguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcaucaccgaggccgagcugaccggcuacgggaccgugacgauggagugcagcccccggaccggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugacguucaagaacccccacgcgaagaagcaggacgucgugguccucggcagccaggagggggccaugcacaccgcccugaccggcgccaccgagauccagacguccagcgggaaccuccuguucaccggccaccugaagugccggcugcgcauggacaagcuccagcugaagggcauguccuacagcaugugcaccgggaaguucaagguggugaaggagaucgccgagacccagcacggcacgaucgucauccgggugcaguacgagggggacggcucccccugccgcauccccuucgagaucauggaccuggagaagcgguacgugcucggccgccugaucaccgucaacccgaucgugaccgagaaggacagccccgugaacaucgaggcggagccgcccuucggggacuccuacaucaucaucggcgucgagccggggcagcugaagcucaacugguucaagaagggcagcuccaucgggcagauguucgagaccacgaugcgcggcgccaagcggauggccauccugggcgacaccgccugggacuucgggagccugggcgggguguucaccuccaucggcaaggcccuccaccagguguucggggcgaucuacggcgccgccuucagcggcgucuccuggaccaugaagauccugaucggggugaucaucacguggaucggcaugaacagccgcuccaccagccuguccgugagccugguccucguggggaucgugacccuguaccugggcgucauggugcaggccgacuccgggugcguggucagcuggaagaacaaggagcucaagugcggcagcggcaucuucaucaccgacaacgugcacacguggaccgagcaguacaaguuccagcccgagucccccagcaagcuggcguccgccauccagaaggcccaggaggaggggaucugcggcauccggagcgugacccgccuggagaaccucauguggaagcagaucacccccgagcugaaccacauccuggccgagaacgaggucaagcucacgaucaugaccggggacaucaagggcaucaugcacgccgggaagcggucccugcgcccgcagcccaccgagcugaaguacagcuggaagaccuggggcaaggcgaagaugcucuccacggagagccacaaccagaccuuccugaucgacggccccgagaccgccgagugcccgaacaccaaccgggccuggaacucccuggagguggaggacuacggguucggcguguucacgaccaacaucuggcucaagcugaaggagaagcaggacgccuucugcgacagcaagcugauguccgccgcgaucaaggacaaccgcgccguccacgccgacaugggguacuggaucgagagcgcccucaacgacaccuggaagaucgagaaggccuccuucaucgaggugaagaacugccacuggcccaagagccacacccugugguccaacggcgugcuggagagcgagaugaucauccccaagaaccucgcgggccccgucucccagcacaacuaccggccgggguaccacacccagaucgccggccccuggcaccuggggaagcuggagauggacuucgacuucugcgacggcacgaccgugguggucaccgaggacugcgggaaccgcggccccagccuccggaccacgaccgccagcggcaagcugaucaccgaguggugcugccgcuccugcacccugcccccgcuccgguaccgcggggaggacggcugcugguacgggauggagauccggccccugaaggagaaggaggagaaccuggugaacagccucgugacggccggccacgggcaggucgacaacuucucccugggcgugcugggcauggcccucuuccuggaggagaugcugcgcacccggguggggaccaagcacgccauccuccuggucgccgugagcuucgugacccugaucacgggcaacauguccuucaaggaccucgggcgcgucguggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccagagcacgauccccgagaccauccuggagcucaccgacgcccuggcgcugggcaugauggugcucaagaucgugcgcaacauggagaaguaccagcuggccgucaccaucauggccauccugugcgugccgaacgccgucauccuccagaacgccuggaagguguccugcacgauccuggcgguggucagcgugagcccccugauccucaccagcucccagcagaagaccgacuggaucccccuggcccugaccaucaaggggcucaaccccacggccaucuuccugaccacccugagccggaccaacaagaagcgcuccuggccgcucaacgaggccaucauggcggugggcauggucagcauccuggccuccagccugcucaagaacgacauccccaugacgggcccccugguggccgggggccugcucaccgugugcuacguccugaccgggcgguccgccgaccuggagcucgagcgcgccaccgacgugaagugggaggaccaggcggagaucagcggcagcucccccauccugagcaucacgaucuccgaggacgggagcauguccaucaagaacgaggaggaggagcagacccugaccauccucauccggaccggccugcuggugaucagcggccucuucccggucuccauccccaucaccgccgccgccugguaccugugggaggugaagaagcagcgcgccggggugcugugggacguccccuccccgccgcccaugggcaaggcggagcucgaggacggggccuaccggaucaagcagaagggcauccugggguacucccagaucggcgccggcguguacaaggaggggacguuccacaccauguggcacgugacccgcggcgccguccugaugcacaaggggaagcggaucgagcccagcugggccgacgugaagaaggaccucaucuccuacggcgggggcuggaagcuggagggcgaguggaaggagggggaggaggugcagguccuggcgcucgagcccggcaagaacccccgcgccgugcagaccaagcccgggcuguucaagacgaacaccggcaccaucggggccgugagccuggacuucucccccggcaccagcggcucccccaucaucgacaagaaggggaaggucgugggccucuacgggaacggcguggucacgcggagcggcgccuacguguccgccaucgcgcagaccgagaaguccaucgaggacaaccccgagaucgaggacgacaucuuccgcaagcggcgccugaccaucauggaccugcaccccggggccggcaagaccaagcgguaccugcccgccaucgugcgcgaggccaucaagcgggggcuccgcacgcugauccuggcgccgacccgggucguggccgccgagauggaggaggcccuccgcggccugcccauccgguaccagacccccgccauccgcgcggagcacaccgggcgcgagaucguggaccugaugugccacgccacguucaccaugcggcuccugucccccguccgcgugccgaacuacaaccugaucaucauggacgaggcccacuucaccgaccccgccagcaucgccgcgcggggcuacaucagcacccgcguggagaugggcgaggccgccgggaucuucaugacggccacgccgcccggcucccgggacccguucccccagagcaacgcccccaucaucgacgaggagcgcgagauccccgagcgguccuggaacagcgggcacgagugggucaccgacuucaagggcaagaccgugugguucgugccguccaucaaggcggggaacgacaucgccgccugccuccgcaagaacggcaagaaggucauccagcugagccggaagacguucgacuccgaguacgugaagacccgcaccaacgacugggacuucguggucaccacggacaucagcgagaugggcgccaacuucaaggcggagcgggugaucgacccccgccggugcaugaagcccgugauccugaccgacggggaggagcgcgucauccucgccggccccaugccggugacccacuucuccgccgcccagcggcgcgggcggaucggccgcaaccccaagaacgagaacgaccaguacaucuacaugggggagccccuggagaacgacgaggacugcgcccacuggaaggaggcgaagaugcugcucgacaacaucaacacccccgagggcaucaucccgagcauguucgagcccgagcgggagaagguggacgccaucgacggcgaguaccgccugcgcggggaggcccggaagacguucgucgaccugaugcgccggggcgaccuccccguguggcuggccuacaagguggccgcggaggggaucaacuacgccgaccgccgguggugcuucgacggcaucaagaacaaccagauccuggaggagaacgucgagguggagaucuggaccaaggagggggagcgcaagaagcucaagccgcgguggcuggacgcccgcaucuacuccgacccccuggcccucaaggaguucaaggaguucgccgcgggccgcaagagccuggcccugaaccucaucaccgagaugggccgccugcccaccuucaugacgcagaagacccgggacgcccuggacaaccucgccguccugcacaccgcggaggccgggggccgcgccuacaaccacgcccuguccgagcuccccgagacccuggagacgcugcuccugcugacccuccuggccaccgugaccgggggcaucuuccuguuccucaugagcggccgggggaucggcaagaugacccuggggaugugcugcaucaucacggcguccauccugcucugguacgcccagauccagccgcacuggaucgccgccagcaucauccugguguucuuccugaucguccuccugauccccgagcccgagaagcagcgcacgccccaggacaaccagcugaccuacguggugaucgccauccucaccgucguggcggccacgauggccaacgagaugggcuuccuggagaagaccaagaaggaccugggguucggcuccaucgccacccagcagccggagagcaacauccucgacaucgaccugcggcccgccuccgcguggacccuguacgccguggccacgaccuucgucacccccaugcuccgccacagcaucgagaacagcuccgugaacgugagccugaccgccaucgccaaccaggcgacgguccugaugggccucgggaagggcuggccccuguccaagauggacaucggggugccgcugcucgccaucggcugcuacagccaggugaaccccaucacccugaccgccgcccugcuccugcuggucgcgcacuacgccaucaucgggcccggccuccaggccaaggccacccgggaggcccagaagcgcgcggccgccggcaucaugaagaaccccacgguggacgggaucaccgugaucgaccuggacccgauccccuacgaccccaaguucgagaagcagcugggccaggucaugcuccuggugcugugcgugacccagguccucaugaugcggaccacgugggcccugugcgaggcccugacccucgcgaccgggcccaucuccacccugugggagggcaacccggggcgcuucuggaacacgaccaucgccgugagcauggccaacaucuuccggggcuccuaccuggccggcgccgggcuccuguucagcaucaugaagaacaccaccaacacgcgccgcggcaccgggaacaucggcaagacccugggcgagaaguggaagucccggcucaacgcgcuggggaagaucgaguuccagaucuacaagaaguccggcauccaggagguggaccgcacccuggccaaggaggggaucaagcggggcgagacggaccaccacgccgucucccgcgggagcgccaagcuccggugguucguggagcgcaacauggugacccccgagggcaaggucguggaccugggcugcgggcggggcgggugguccuacuacugcggcgggcugaagaacgugcgcgaggucaagggccucaccaagggcgggcccggccacgaggagcccaucccgaugagcaccuacggguggaaccuggugcggcugcaguccggcguggacgucuucuucaucccgcccgagaagugcgacacgcuccugugcgacaucggggagagcucccccaacccgaccguggaggcgggccgcacccugcgggugcucaaccuggucgagaacuggcugaacaacaacacccaguucugcaucaaggugcucaaccccuacaugcccagcgugaucgagaagauggaggcccugcagcgcaaguacggcggggcccugguccggaacccgcugucccgcaacagcacccacgagauguacugggugagcaacgccuccggcaacaucgugagcuccgucaacaugaucagccggaugcucaucaaccgcuucacgaugcggcacaagaaggccaccuacgagcccgacguggaccugggguccggcacccgcaacaucgggaucgagagcgagauccccaaccuggacaucaucggcaagcggaucgagaagaucaagcaggagcacgagaccuccuggcacuacgaccaggaccaccccuacaagacgugggcguaccacggcagcuacgagaccaagcagaccggguccgccagcuccauggugaacggcgucgugcgccuccugaccaagccgugggacgugcugcccacggucacccagauggccaugaccgacaccacgcccuucgggcagcagcgcguguucaaggagaagguggacacccggacccaggagcccaaggagggcaccaagaagcucaugaagaucacggccgaguggcuguggaaggagcugggcaagaagaagaccccgcgcaugugcacccgggaggaguucacccgcaagguccggagcaacgccgcgcucggggccaucuucacggacgagaacaaguggaaguccgcccgcgaggccguggaggacagccgguucugggagcuggucgacaaggagcgcaaccugcaccucgagggcaagugcgagaccugcguguacaacaugauggggaagcgggagaagaagcugggcgaguucgggaaggccaagggcucccgcgcgaucugguacauguggcugggcgcccgguuccucgaguucgaggcccugggguuccugaacgaggaccacugguucagccgcgagaacucccucagcggcguggagggggagggccugcacaagcugggguacauccuccgggacgucuccaagaaggagggcggcgccauguacgcggacgacaccgccgggugggacacccgcaucacgcuggaggaccugaagaacgaggagauggugaccaaccacauggagggcgagcacaagaagcucgccgaggccaucuucaagcugaccuaccagaacaaggugguccgggugcagcgccccacgccccgggggacggugauggacaucaucagccgccgggaccagcgcggcagcgggcaggucggcaccuacggccugaacaccuucaccaacauggaggcccagcucauccggcagauggagggggagggcguguucaagaacauccagcaccugacggcgaccgaggagaucgccgugcagaacuggcuggcccgcgucgggcgcgagcggcucucccgcauggccaucagcggcgacgacugcguggugaagccccuggacgaccgguucgccuccgcgcugaccgcccucaacgacaugggcaagauccgcaaggacauccagcagugggagccgagccggggguggaacgacuggacccagguccccuucugcucccaccacuuccacgagcugaucaugaaggacggccgcgugcuggugguccccugccggaaccaggacgagcucaucgggcgcgcccggaucagccagggcgccggguggucccugcgcgagacggccugccugggcaagagcuacgcgcagauguggucccucauguacuuccaccggcgcgaccugcggcuggccgccaacgccaucugcagcgccgugcccucccacugggugccgaccagccgcaccaccugguccauccacgcgaagcacgaguggaugaccacggaggacaugcucaccgucuggaaccggguguggauccaggagaaccccuggauggaggacaagacccccguggagagcugggaggagauccccuaccugggcaagcgcgaggaccaguggugcgggucccugaucggccucaccagccgggccacgugggccaagaacauccaggccgcgaucaaccagguccgcucccugaucgggaacgaggaguacaccgacuacaugccgagcaugaagcgguuccgccgcgaggaggaggaggccggcgugcugugguga

SEQ ID NO: 9812 - RNA, 9873 nt, Artificial Sequence
  derived and/or modified CDS sequence (opt1) from DENV-3__AB189125__SS-prME
accucccugugccucaugaugaugcugcccgccacccuggccuuccaccucaccucccgcgacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcgcgcagaccuggaugagcgccgagggcgccuggcgccagguggagaaggucgagacgugggccuuccgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugcccgaggagcaggaccagaacuacgucugcaagcacaccuacguggaccggggguggggcaacgggugcggccucuucgggaagggcucccuggugaccugcgccaaguuccagugccuggagcucaucgagggcaaggucgugcagcacgagaaccugaaguacaccgugaucaucacgguccacaccggggaccagcaccaggugggcaacgagacccagggggucaccgccgagaucacgccccaggccagcaccguggaggcgauccugcccgaguacggcacccucgggcuggagugcagcccccggaccggccuggacuucaacgagaugauccuccugaccaugaagaacaaggccuggauggugcaccggcagugguucuucgaccugccgcuccccuggacgagcggcgccaccaccgagacccccacguggaacaagaaggagcugcuggucaccuucaagaacgcccacgccaagaagcaggagguggugguccucgggucccaggagggcgcgaugcacaccgcccugaccggggccacggagauccagaccagcggcgggaccuccaucuucgccggccaccugaagugccgccucaagauggacaagcuggagcugaagggcaugagcuacgccaugugcuccaacgcguucgugcucaagaaggaggugagcgagacccagcacgggacgauccugaucaaggucgaguacaagggcgaggacgcccccugcaagaucccguucagcaccgaggacgggcagggcaaggcccacaacggccggcugaucaccgccaaccccguggugaccaagaaggaggagcccgucaacaucgaggcggagcccccguucggggaguccaacaucaucaucggcaucggggacaaggcccugaagaucaacugguacaagaagggcagcuccaucgggaagauguucgaggccacggcccgcggcgcccggcgcauggcgauccucggcgacaccgccugggacuucgggagcgugggcggggugcugaacucccugggcaagaugguccaccagaucuucgggagcgccuacaccgcccucuucuccggcgugagcuggaucaugaagaucggcaucggggugcugcugaccuggaucggccucaacuccaagaacacgagcauguccuucagcugcaucgucaucgggaucaucacccuguaccugggcgccguggugcaggcggacauggggugcgucaucaacuggaagggcaaggagcucaagugcggcuccgggaucuucgugaccaacgaggugcacaccuggacggagcaguacaaguuccaggccgacagccccaagcggcuggccaccgccaucgccggcgcgugggagaacggggucugcggcauccgcuccaccacccgcauggagaaccugcucuggaagcagaucgccaacgagcugaacuacauccugugggagaacaacaucaagcucacggugguggucggggacaucaucggcauccuggagcagggcaagcggacccugacgccccagcccauggagcucaaguacagcuggaagaccugggggaaggccaagaucgugacggccgagauccagaacuccagcuucaucaucgacggcccgaacacccccgagugccccaacgcgucccgcgccuggaacgugugggaggucgaggacuacggguucggcguguucaccaccaacaucuggcugaagcugcgggagauguacacgcagcucugcgaccaccgccugaugagcgccgccgugaaggacgagcgggccguccacgcggacaugggcuacuggaucgagagccagaagaacggguccuggaagcuggagaaggccagccucaucgaggugaagaccugcaccuggcccaagucccacacccuguggagcaacggcgugcuggaguccgacaugaucauccccaagucccucgccgggcccaucucccagcacaacuaccgccccggcuaccacacccagacggccgggccguggcaccugggcaagcuggagcucgacuucaacuacugcgagggcaccaccgucgugaucaccgagaacugcgggacgcggggccccagccugcgcaccaccaccguguccgggaagcugauccacgaguggugcugccggagcugcacgcugccgccccuccgcuacaugggcgaggacgggugcugguacggcauggagauccggccgaucaacgagaaggaggagaacauggucaagucccuggugagcgccggcuccgggaagguggacaacuucaccaugggcguccucugccuggcgauccuguucgaggaggugaugcgcgggaaguucggcaagaagcacaugaucgccgggguccuguucaccuucguccugcugcucagcggccagaucaccuggcgggacauggcccgcacgcugaucaugaucggcuccaacgccagcgaccggauggggaugggcgugaccuaccuggcccucaucgcgaccuucaagauccagcccuuccuggcccugggguucuuccuccgcaagcugaccucccgggagaaccugcuccugggcgugggccuggccauggccacgacccuccagcugcccgaggacaucgagcagauggcgaacgggaucgcccugggccucauggcccugaagcugaucacccaguucgagaccuaccagcucuggacggcccuggucagccugaugugcagcaacaccaucuucacccucaccguggccuggcgcacggcgacccugauccuggccgggaucucccuccugcccgugugccagagcuccagcaugcggaagaccgacuggcugccgaugaccgucgccgccaugggcgugccgccccucccccuguucaucuucucccugaaggacacgcucaagcgccgcagcuggccgcugaacgagggggucauggccgugggccugguguccauccucgcgagcucccugcugcggaacgacguccccauggccggcccccucguggccgggggccugcugaucgccugcuacgugaucaccgggaccagcgccgaccucaccgucgagaaggcggccgacgugacgugggaggaggaggccgagcagaccggcgugucccacaaccugaugaucaccgucgacgacgacgggaccaugcgcaucaaggacgacgagacggagaacauccugaccgugcuccugaagaccgcccugcucaucgugagcggcaucuuccccuacuccaucccggccacccugcuggucuggcacaccuggcagaagcagacgcagcggagcggcgugcucugggacgugcccagcccgcccgagacccagaaggcggagcuggaggagggggucuaccgcaucaagcagcagggcaucuucgggaagacccaggugggcguggggguccagaaggagggcguguuccacaccauguggcacgugacgcggggcgccguccugaccuacaacgggaagcgccucgagccgagcugggccuccgugaagaaggaccugaucagcuacggcgggggcuggcggcuguccgcccaguggcagaagggggaggaggugcaggucaucgcgguggagcccggcaagaaccccaagaacuuccagaccaugcccggcaucuuccagaccacgaccggggagaucggcgccaucgcccuggacuucaagccggggaccagcggcagccccaucaucaaccgcgagggcaagguggucgggcucuacggcaacgggguggugaccaagaacggcggguacgucuccggcaucgcccagacgaacgccgagcccgacggcccgacccccgagcuggaggaggagauguucaagaagcggaaccugaccaucauggaccuccaccccgggagcggcaagacccgcaaguaccugcccgcgaucgugcgggaggccaucaagcgccggcugcgcacgcucauccuggccccgacccggguggucgccgccgagauggaggaggcgcugaaggggcuccccauccgcuaccagaccaccgccacgaaguccgagcacaccggcaaggagaucguggaccugaugugccacgccaccuucaccaugcggcugcucagccccgugcgcguccccaacuacaaccugaucaucauggacgaggcccacuucacggacccggccuccaucgcggcccggggguacaucagcacccgcgugggcaugggcgaggccgccgcgaucuucaugaccgccacgccgcccgggacggccgacgccuucccccaguccaacgccccgauccaggacgaggagcgggacauccccgagcgcagcuggaacuccggcaacgacuggaucaccgacuucgcggggaagaccgugugguucguccccagcaucaaggccggcaacgacaucgccaacugccugcgcaagaacgggaagaaggugauccagcucucccggaagaccuucgacacggaguaccagaagaccaagcugaacgacugggacuucguggucaccaccgacaucagcgagaugggcgccaacuucaaggccgaccgcgugaucgacccccggcgcugccugaagccggugauccucacggacggccccgagcgggucauccuggcggggcccaugcccgugaccguggccuccgccgcccagcgccggggccgcgucgggcggaacccgcagaaggagaacgaccaguacaucuucaccggccagccccugaacaacgacgaggaccacgcccacuggaccgaggcgaagaugcuccuggacaacaucaacacgcccgaggggaucauccccgcccuguucgagccggagcgcgagaaguccgccgccaucgacggcgaguaccggcucaagggcgagagccgcaagaccuucguggagcugaugcggcgcggggaccugcccguguggcucgcgcacaaggucgccagcgagggcaucaaguacaccgaccggaaguggugcuucgacggggagcgcaacaaccagauccuggaggagaacguggacgucgagaucuggaccaaggagggcgagaagaagaagcugcggccccgcuggcucgacgcccggaccuacuccgacccccuggcccugaaggaguucaaggacuucgccgcgggccgcaagagcaucgcccucgaccuggugacggagaucgggcgcgugccgucccaccuggcccaccggacccgcaacgcccucgacaaccuggucaugcugcacaccagcgagcacggcgggcgggccuaccgccacgcgguggaggagcuccccgagaccauggagacgcugcugcuccugggccugaugauccuccugaccgggggcgugaugcuguuccucaucagcggcaagggggucggcaagaccuccaucgggcugaucugcgugguggccagcuccggcaugcuguggauggccgacaucccccuccaguggaucgccagcgccaucguccuggaguucuucaugauggugcugcucaucccggagcccgagaagcagcggacgccccaggacaaccagcuggcguacguggucaucgggauccugacgcucgccgccaucguggccgccaacgagaugggccugcuggagaccaccaagcgcgaccucggcauguccaaggagcccgggguggucagcccgaccuccuaccuggacguggaccugcaccccgcgagcgccuggacgcucuacgccguggccaccaccgucaucacccccaugcugcggcacacgaucgagaacuccaccgcgaacgugagccuggccgccaucgccaaccaggccgugguccucaugggccuggacaagggguggcccaucuccaagauggaccugggcgugccgcuccuggcgcuggggugcuacagccaggugaacccccucacccugaccgccgccguccugcuccuggugacgcacuacgccaucaucggccccggccugcaggccaaggcgacccgcgaggcccagaagcggaccgccgccgggaucaugaagaaccccaccguggacggcaucaugacgaucgaccucgacccggucaucuacgacuccaaguucgagaagcagcugggccaggugaugcugcucgugcugugcgccguccagcugcuccugaugcgcaccagcugggcguucugcgaggcccugacccucgccaccggccccaucacgacccugugggagggcucccccgggaaguucuggaacaccaccaucgccgugagcauggcgaacaucuuccggggcuccuaccuggccggggccggccucgccuucagcaucaugaaguccguggggacgggcaagcgcggcaccgggagccagggcgagacccugggggagaaguggaagaagaagcugaaccagcucagccggaaggaguucgaccuguacaagaaguccggcaucaccgaggucgaccgcacggaggccaaggaggggcugaagcggggcgagaucacccaccacgcggugagccgcggcuccgccaagcuccagugguucguggagcggaacauggucauccccgaggggcgcgugaucgaccugggcugcgggcggggcggguggagcuacuacugcgccggccugaagaaggugaccgagguccgcggcuacaccaagggcgggccggggcacgaggagcccgugcccauguccaccuacggcuggaacaucgugaagcucaugagcgggaaggacgucuucuaccugcccccggagaagugcgacacgcugcugugcgacaucggcgaguccagccccucccccaccguggaggagagccggaccauccgcgugcucaagauggucgagcccuggcugaagaacaaccaguucugcaucaaggugcugaacccguacaugcccgccgugaucgagcaccucgagcgccugcagcggaagcacggcgggaugcugguccgcaacccccucucccggaacagcacccacgagauguacuggaucuccaacggcacggggaacaucgugagcuccgugaacauggucagccgccugcugcucaaccgguucaccaugaccuaccgccggcccaccaucgagaaggacguggaccugggcgccggcacgcgccacgucaacgcggagccggagacccccaacauggacgugaucggggagcggauccgccggaucaaggaggagcacuccagcaccuggcacuacgacgacgagaaccccuacaagaccugggccuaccacggcuccuacgaggugaaggccacggggagcgccagcuccaugaucaacggcgucgugaagcugcucaccaagccgugggacgugguccccaccgugacccagauggccaugacggacaccacccccuucgggcagcagcgcguguucaaggagaaggucgacacccggacgcccaagccgaugcccggcacccgcaaggugauggagaucaccgcggaguggcuguggcggacccugggccgcaacaagcggccccgccucugcacgcgggaggaguucaccaagaaggugcgcaccaacgccgccaugggggccgucuucaccgaggagaaccagugggacagcgcgcgcgccgccguggaggacgaggaguucuggaagcugguggaccgggagcgcgagcugcacaagcucggcaagugcggguccugcgucuacaacaugaugggcaagcgggagaagaagcugggggaguucggcaaggccaagggcagccgcgccaucugguacauguggcugggggcgcgguaccucgaguucgaggcccugggcuuccugaacgaggaccacugguucucccgcgagaacagcuacuccgggguggagggcgaggggcuccacaagcugggcuacauccugcgggacaucagcaagauccccggcggggccauguacgccgacgacacggccggcugggacacccgcaucaccgaggacgaccuccacaacgaggagaagaucacccagcagauggacccggagcaccggcagcuggcgaacgccaucuucaagcugacguaccagaacaagguggucaaggugcagcgccccacccccaaggggaccgugauggacaucaucucccggaaggaccagcgcggcagcggccaggucgggaccuacggccucaacacguucaccaacauggaggcccagcugauccggcagauggagggggagggcgugcuguccaagaccgaccucgagaacccccaccuccuggagaagaagaucacccaguggcucgagaccaaggggguggagcgccugaagcggauggccaucagcggcgacgacugcgucgugaagccgaucgacgaccgcuucgccaacgcgcugcucgcccugaacgacaugggcaaggugcggaaggacaucccccaguggcagcccuccaagggguggcacgacuggcagcagguccccuucugcagccaccacuuccacgagcugaucaugaaggacggccgcaagcucguggugccgugccggucccaggacgagcugaucgggcgcgcccggaucagccagggcgccggguggucccugaaggagacggccugccucggcaaggcguacgcccagaugugggcccugauguacuuccaccgccgcgaccugcggcucgccagcaacgcgaucugcuccgccguccccgugcacugggugcccaccagccgcaccaccuggagcauccacgcccaccaccaguggaugacgaccgaggacaugcugaccgucuggaaccggguguggaucgaggacaaccccuggauggaggacaagaccccggugacgaccugggaggacguccccuaccugggcaagcgcgaggaccaguggugcgggucccucaucggccugaccagccgggccaccugggcccagaacauccugacggcgauccagcagguccgcucccucaucgggaacgaggaguuccuggacuacaugcccagcaugaagcgguuccgcaaggaggaggaguccgagggcgccaucugguga

SEQ ID NO: 9813 - RNA, 9873 nt, Artificial Sequence
  derived and/or modified CDS sequence (opt1) from DENV-3__AB189126__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccugaucaccgagguggagcccgaggacaucgacugcuggugcaaccucaccagcaccugggugacguacgggaccugcaaccaggccggcgagcaccggcgcgacaagcgguccgucgcccuggccccccacgugggcauggggcuggacacccgcgcgcagaccuggaugagcgccgagggcgccuggcggcagguggagaaggucgagacgugggccuuccgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugccggaggagcaggaccagaacuacgucugcaagcacaccuacguggaccggggguggggcaacgggugcggccucuucgggaagggcucccuggugaccugcgccaaguuccagugccuggagcucaucgagggcaaggucgugcagcacgagaaccugaaguacaccgugaucaucacgguccacaccggggaccagcaccaggugggcaacgagacccagggggucaccgccgagaucacgccccaggccagcaccguggaggcgauccugcccgaguacggcacccucgggcuggagugcuccccccgcaccggccuggacuucaacgagaugauccuccugaccaugaagaacaaggccuggauggugcaccggcagugguucuucgaccugccgcuccccuggacgagcggcgccaccaccgagacccccacguggaacaagaaggagcugcuggucaccuucaagaacgcccacgccaagaagcaggagguggugguccucgggucccaggagggcgcgaugcacaccgcccugaccggggccacggagauccagaccagcggcgggaccuccaucuucgccggccaccugaagugccgccucaagauggacaagcuggagcugaagggcaugagcuacgccaugugcuccaacgcguucgugcucaagaaggaggugagcgagacccagcacgggacgauccugaucaaggucgaguacaagggcgaggacgcccccugcaagaucccguucagcaccgaggacgggcagggcaaggcccacaacggccggcugaucaccgccaaccccguggugaccaagaaggaggagcccgucaacaucgaggcggagcccccguucggggaguccaacaucaucaucggcaucggggacaaggcccugaagaucaacugguacaagaagggcagcuccaucgggaagauguucgaggccacggcccgcggcgcccggcgcauggcgauccucggcgacaccgccugggacuucgggagcgugggcggggugcugaacucccugggcaagaugguccaccagaucuucgggagcgccuacaccgcccucuucuccggcgugagcuggaucaugaagaucggcaucggggugcugcugaccuggaucggccucaacuccaagaacacgagcauguccuucagcugcaucgucaucgggaucaucacccuguaccugggcgccguggugcaggcggacauggggugcgucaucaacuggaagggcaaggagcucaagugcggcuccgggaucuucgugaccaacgaggugcacaccuggacggagcaguacaaguuccaggccgacagccccaagcggcuggccaccgccaucgccggcgcgugggagaacggggucugcggcauccgcuccaccacccgcauggagaaccugcucuggaagcagaucgccaacgagcugaacuacauccugugggagaacaacaucaagcucacggugguggucggggacaucaucggcgugcuggagcagggcaagcggacccugaccccccagcccauggagcucaaguacagcuggaagaccugggggaaggccaagguggucacggccgagauccagaacuccagcuucaucaucgacggcccgaacacccccgagugccccaacgcgucccgcgccuggaacgugugggagguggaggacuacggguucggcgucuucaccaccaacaucuggcugaagcugcgggagauguacacgcagcucugcgaccaccgccugaugagcgccgccgugaaggacgagcgggccgugcacgcggacaugggcuacuggaucgagagccagaagaacggguccuggaagcuggagaaggccagccucaucgaggucaagaccugcaccuggcccaagucccacacccuguggagcaacggcgugcuggaguccgacaugaucaucccgaagagccucgccgggcccaucucccagcacaacuaccgccccggcuaccacacccagacggccgggccguggcaccugggcaagcuggagcucgacuucaacuacugcgagggcaccaccguggucaucaccgagaacugcgggacgcggggccccagccugcgcaccaccaccguguccgggaagcugauccacgaguggugcugccggagcugcacgcuccccccccugcgcuacaugggcgaggacgggugcugguacggcauggagauccggccgaucaacgagaaggaggagaacauggugaagucccuggucagcgccggcuccgggaagguggacaacuucaccaugggcgugcucugccuggcgauccuguucgaggaggucaugcgcgggaaguucggcaagaagcacaugaucgccgggauccucuucaucuucgugcugcugcucagcggccagaucaccuggcgggacauggcccgcacccugaucaugaucggcuccaacgccagcgaccggauggggaugggcgugacguaccuggcccucaucgcgaccuucaagauccagcccuuccuggcccugggguucuuccuccgcaagcugaccucccgggagaaccugcuccugggcgucggccuggccauggccaccacgcuccagcugcccgaggacaucgagcagauggcgaacgggaucgcccugggccucauggcccugaagcugaucacccaguucgagaccuaccagcucuggaccgcccuggugagccugacgugcagcaacaccaucuucacccucaccguggccuggcgcacggcgacccugauccuggccgggaucucccuccugcccgucugccagagcuccagcaugcggaagaccgacuggcugccgaugaccguggccgccaugggcguccccccccucccccuguucaucuucucccugaaggacacgcucaagcgccgcagcuggccgcugaacgagggggugauggccgugggccuggucuccauccucgcgagcucccugcugcggaacgacgugcccauggccggcccccucguggccgggggccugcugaucgccugcuacgucaucaccgggaccagcgccgaccucaccguggagaaggcggccgacgugacgugggaggaggaggccgagcagaccggcgucucccacaaccugaugaucaccguggacgacgacgggaccaugcgcaucaaggacgacgagacggagaacauccugaccgugcuccugaagaccgcccugcucaucgucagcggcaucuuccccuacuccaucccggccacccugcugguguggcacaccuggcagaagcagacgcagcggagcggcgugcucugggacguccccuccccccccgagacccagaaggcggagcuggaggaggggguguaccgcaucaagcagcagggcaucuucgggaagacccaggugggcgucggggugcagaaggagggcguguuccacaccauguggcacgucacgcggggcgccgugcugaccuacaacgggaagcgccucgagccgaacugggccagcgugaagaaggaccugaucuccuacggcgggggcuggcggcugagcgcccaguggcagaagggggaggagguccaggugaucgcgguggagcccggcaagaaccccaagaacuuccagaccaugcccggcaucuuccagaccacgaccggggagaucggcgccaucgcccuggacuucaagccggggaccuccggcagccccaucaucaaccgcgagggcaaggucguggggcucuacggcaacgggguggucaccaagaacggcggguacgugagcggcaucgcccagacgaacgccgagcccgacggcccgacccccgagcuggaggaggagauguucaagaagcggaaccugaccaucauggaccuccaccccggguccggcaagacccgcaaguaccugcccgcgaucgugcgggaggccaucaagcgccggcugcgcacgcucauccuggccccgacccgggucguggccgccgagauggaggaggcgcugaaggggcuccccauccgcuaccagaccaccgccacgaagagcgagcacaccggcaaggagaucguggaccugaugugccacgccaccuucaccaugcggcugcucucccccguccgcgugcccaacuacaaccugaucaucauggacgaggcccacuucacggacccggccagcaucgcggcccggggguacaucuccacccgcgugggcaugggcgaggccgccgcgaucuucaugaccgccaccccccccgggacggccgacgccuucccccagagcaacgccccgauccaggacgaggagcgggacauccccgagcgcuccuggaacagcggcaacgacuggaucaccgacuucgcggggaagaccgucugguucgugcccuccaucaaggccggcaacgacaucgccaacugccugcgcaagaacgggaagaaggugauccagcucagccggaagaccuucgacacggaguaccagaagaccaagcugaacgacugggacuucgucgugaccaccgacaucuccgagaugggcgccaacuucaaggccgaccgcgugaucgacccccggcgcugccugaagccggucauccucacggacggccccgagcgggugauccuggcggggcccaugcccgugaccgucgccagcgccgcccagcgccggggccgcguggggcggaacccgcagaaggagaacgaccaguacaucuucaccggccagccccugaacaacgacgaggaccacgcccacuggaccgaggcgaagaugcuccuggacaacaucaacacgcccgaggggaucauccccgcccuguucgagccggagcgcgagaaguccgccgccaucgacggcgaguaccggcucaagggcgagagccgcaagaccuucguggagcugaugcggcgcggggaccugcccgucuggcucgcgcacaagguggccuccgagggcaucaaguacaccgaccggaaguggugcuucgacggggagcgcaacaaccagauccuggaggagaacauggacgucgagaucuggaccaaggagggcgagaagaagaagcugcggccccgcuggcucgacgcccggaccuacagcgacccccuggcccugaaggaguucaaggacuucgccgcgggccgcaaguccaucgcccucgaccuggugacggagaucgggcgcgugccgagccaccuggcccaccggacccgcaacgcccucgacaaccuggucaugcugcacaccuccgagcacggcgggcgggccuaccgccacgcgguggaggagcuccccgagaccauggagacgcugcugcuccugggccugaugauccuccugaccgggggcgccaugcuguuccucaucagcggcaagggggugggcaagaccagcaucgggcugaucugcgucguggccuccagcggcaugcuguggauggccgacaucccccuccaguggaucgccuccgcgaucgugcuggaguucuucaugaugguccugcucaucccggagcccgagaagcagcggaccccccaggacaaccagcuggccuacguggugaucgggauccugacgcucgccgccaucgucgccgcgaacgagaugggccugcuggagaccaccaagcgcgaccucggcaugagcaaggagcccgggguggugccgcccaccuccuaccuggacgucgaccugcaccccgccagcgccuggacgcucuacgccguggcgaccaccgugaucacccccaugcugcggcacacgaucgagaacuccaccgccaacgucagccuggccgccaucgccaaccaggcgguggugcucaugggccuggacaagggguggccgaucuccaagauggaccugggcgucccccuccuggcccuggggugcuacagccaggugaacccccucacccugaccgccgccgugcugcuccuggucacgcacuacgccaucaucggccccggccugcaggcgaaggccacccgcgaggcccagaagcggaccgccgccgggaucaugaagaacccgaccguggacggcaucaugacgaucgaccucgaccccgugaucuacgacuccaaguucgagaagcagcuggggcaggucaugcugcucgugcugugcgcggugcagcugcuccugaugcgcaccagcugggccuucugcgaggcccugacccucgccaccggccccaucacgacccugugggagggcucccccgggaaguucuggaacaccaccaucgcggucagcauggccaacaucuuccggggcuccuaccuggccggggccggccucgccuucagcaucaugaaguccguggggacgggcaagcgcggcaccgggagccagggcgagacccugggggagaaguggaagaagaagcugaaccagcucucccggaaggaguucgaccuguacaagaagagcggcaucaccgagguggaccgcacggaggcgaaggaggggcugaagcggggcgagaucacccaccacgccgucagccgcggcuccgccaagcuccagugguucguggagcggaacauggugaucccggaggggcgcgucaucgaccugggcugcgggcggggcggguggagcuacuacugcgccggccugaagaaggugaccgaggugcgcggcuacaccaaggggggccccgggcacgaggagcccguccccauguccaccuacggcuggaacaucgugaagcucaugagcgggaaggacguguucuaccugccgcccgagaagugcgacacgcugcugugcgacaucggcgaguccagccccucccccaccgucgaggagagccggaccauccgcgugcucaagaugguggagccguggcugaagaacaaccaguucugcaucaagguccugaaccccuacaugcccaccgugaucgagcaccucgagcgccugcagcggaagcacggcgggaugcuggugcgcaacccccucucccggaacagcacgcacgagauguacuggaucuccaacggcaccgggaacaucgucagcuccgugaacauggugagccgccugcugcucaaccgguucaccaugacccaccgccggccgacgaucgagaaggacgucgaccugggcgccggcacccgccacgugaacgcggagcccgagacccccaacauggacgucaucggggagcggauccgccggaucaaggaggagcacuccagcaccuggcacuacgacgacgagaacccguacaagacgugggccuaccacggcuccuacgaggugaaggccaccgggagcgccuccagcaugaucaacggcguggucaagcugcucaccaagcccugggacguggugcccaccgucacgcagauggccaugaccgacaccacccccuucgggcagcagcgcguguucaaggagaagguggacacgcggaccccgaagcccaugcccggcacccgcaaggucauggagaucaccgcggaguggcuguggcggacgcugggccgcaacaagcggccccgccucugcacccgggaggaguucaccaagaaggugcgcaccaacgccgccaugggggccguguucacggaggagaaccagugggacagcgcgcgcgccgccgucgaggacgaggaguucuggaagcugguggaccgggagcgcgagcugcacaagcucggcaagugcggguccugcguguacaacaugaugggcaagcgggagaagaagcugggggaguucggcaaggccaagggcagccgcgccaucugguacauguggcugggggcgcgguaccucgaguucgaggcccugggcuuccugaacgaggaccacugguucucccgcgagaacagcuacuccggggucgagggcgaggggcuccacaagcugggcuacauccugcgggacaucagcaagaucccgggcggggccauguacgccgacgacaccgccggcugggacacccgcaucaccgaggacgaccuccacaacgaggagaagaucacgcagcagauggaccccgagcaccggcagcuggcgaacgccaucuucaagcugaccuaccagaacaagguggugaagguccagcgccccacccccaaggggaccgugauggacaucaucucccggaaggaccagcgcggcagcggccagguggggacguacggccucaacaccuucaccaacauggaggcccagcugauccggcagauggagggggagggcguccuguccaagaccgaccucgagaacccgcaccugcuggagaagaagaucacccaguggcucgagacgaaggggguggagcgccugaagcggauggccaucagcggcgacgacugcguggucaagcccaucgacgaccgcuucgccaacgcgcugcucgcccugaacgacaugggcaaggugcggaaggacaucccccaguggcagcccuccaagggguggcacgacuggcagcaggugccguucugcagccaccacuuccacgagcugaucaugaaggacggccgcaagcucgucgugcccugccggccccaggacgagcugaucgggcgcgcccggaucucccagggcgccggguggagccugaaggagaccgccugccucggcaaggcguacgcccagaugugggcccugauguacuuccaccgccgcgaccugcggcucgccuccaacgcgaucugcagcgccgugcccguccacugggugccgaccucccgcaccacguggagcauccacgcccaccaccaguggaugaccaccgaggacaugcugaccguguggaaccgggucuggaucgaggacaaccccuggauggaggacaagacgcccgugaccaccugggaggacgugcccuaccugggcaagcgcgaggaccaguggugcgggucccucaucggccugaccagccgggccacgugggcccagaacauccugaccgcgauccagcagguccgcagccucaucgggaacgaggaguuccuggacuacaugccguccaugaagcgguuccgcaaggaggaggagcuggagggcgccaucugguga

SEQ ID NO: 9814 - RNA, 9873 nt, Artificial Sequence
  derived and/or modified CDS sequence (opt1) from DENV-3__AB189127__SS-prME
accagccugugccucaugaugaugcugcccgccacccuggccuuccaccucaccagccgcgacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcgcgcagaccuggaugagcgccgagggcgccuggcgccagguggagaaggucgagacgugggccuuccgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugcccgaggagcaggaccagaacuacgucugcaagcacaccuacguggaccggggguggggcaacgggugcggccucuucgggaagggcucccuggugaccugcgccaaguuccagugccuggagcucaucgagggcaaggucgugcagcacgagaaccugaaguacaccgugaucaucacgguccacaccggggaccagcaccaggugggcaacgagacccagggggucaccgccgagaucacgccccaggccagcaccguggaggcgauccugcccgaguacggcacccucgggcuggagugcagcccccggaccggccuggacuucaacgagaugauccuccugaccaugaagaacaaggccuggauggugcaccggcagugguucuucgaccugccgcuccccuggacgagcggcgccaccaccgagacccccacguggaacaagaaggagcugcuggucaccuucaagaacgcccacgccaagaagcaggagguggugguccucgggucccaggagggcgcgaugcacaccgcccugaccggggccacggagauccagaccagcggcgggaccuccaucuucgccggccaccugaagugccgccucaagauggacaagcuggagcugaagggcaugagcuacgccaugugcuccaacgcguucgugcucaagaaggaggugagcgagacccagcacgggacgauccugaucaaggucgaguacaagggcgaggacgcccccugcaagaucccguucagcaccgaggacgggcagggcaaggcccacaacggccggcugaucaccgccaaccccguggugaccaagaaggaggagcccgucaacaucgaggcggagcccccguucggggaguccaacaucaucaucggcaucggggacaaggcccugaagaucaacugguacaagaagggcagcuccaucgggaagauguucgaggccacggcccgcggcgcccggcgcauggcgauccucggcgacaccgccugggacuucgggagcgugggcggggugcugaacucccugggcaagaugguccaccagaucuucgggagcgccuacaccgcccucuucuccggcgugagcuggaucaugaagaucggcaucggggugcugcugaccuggaucggccucaacuccaagaacacgagcauguccuucagcugcaucgucaucgggaucaucacccuguaccugggcgccguggugcaggcggacauggggugcgucaucaacuggaagggcaaggagcucaagugcggcuccgggaucuucgugaccaacgaggugcacaccuggacggagcaguacaaguuccaggccgacagccccaagcggcuggccaccgccaucgccggcgcgugggagaacggggucugcggcauccgcuccaccacccgcauggagaaccugcucuggaagcagaucgccaacgagcugaacuacauccugugggagaacaacaucaagcucacggugguggucggggacaucaucggcgugcuggagcagggcaagcggacccugacgccccagcccauggagcucaaguacagcuggaagaccugggggaaggccaagguggucacggccgagauccagaacuccagcuucaucaucgacggcccgaacacccccgagugccccaacgcgucccgcgccuggaacgugugggagguggaggacuacggguucggcgucuucaccaccaacaucuggcugaagcugcgggagauguacacgcagcucugcgaccaccgccugaugagcgccgccgugaaggacgagcgggccauccacgcggacaugggcuacuggaucgagagccagaagaacggguccuggaagcuggagaaggccagccucaucgaggugaagaccugcaccuggcccaagucccacacccuguggagcaacggcguccuggaguccgacaugaucauccccaagucccucgccgggcccaucucccagcacaacuaccgccccggcuaccacacccagacggccgggccguggcaccugggcaagcuggagcucgacuucaacuacugcgagggcaccaccguggugaucaccgagaacugcgggacgcggggccccagccugcgcaccaccaccgucuccgggaagcugauccacgaguggugcugccggagcugcacgcugccgccccuccgcuacaugggcgaggacgggugcugguacggcauggagauccggccgaucaacgagaaggaggagaacauggugaagucccuggugagcgccggcuccgggaaggucgacaacuucaccaugggcgugcucugccuggcgauccuguucgaggaggugaugcgcgggaaguucggcaagaagcacaugaucgccgggauccucuucauguucguccugcugcucagcggccagaucaccuggcgggacauggcccgcacccugaucaugaucggcuccaacgccagcgaccggauggggaugggcgugacguaccuggcccucaucgcgaccuucaagauccagcccuuccuggcccugggguucuuccuccgcaagcugaccucccgggagaaccugcuccugggcgugggccuggccauggccaccacgcuccagcugcccgaggacaucgagcagauggcgaacgggaucgcccugggccucauggcccugaagcugaucacccaguucgagaccuaccagcucuggaccgcccuggucagccugacgugcagcaacaccaucuucacccucaccguggccuggcgcacggcgacccugauccuggccgggaucucccuccugcccgugugccagagcuccagcaugcggaagaccgacuggcugccgaugaccgucgccgccaugggcgugccgccccugccccuguucaucuucucccugaaggacacgcucaagcgccgcagcuggccgcugaacgagggggucauggccgugggccugguguccauccucgcgagcucccugcugcggaacgacguccccauggccggcccccucguggccgggggccugcugaucgccugcuacgugaucaccgggaccagcgccgaccucaccgucgagaaggcggccgacgugacgugggaggaggaggccgagcagaccggcgugucccacaaccugaugaucaccgucgacgacgacgggaccaugcgcaucaaggacgacgagacggagaacauccugaccgugcuccugaagaccgcccugcucaucgugagcggcaucuuccccuacuccaucccggccacccugcuggucuggcacaccuggcagaagcagacgcagcggagcggcgugcucugggacgugcccagcccgcccgagacccagaaggcggagcuggaggagggggucuaccgcaucaagcagcagggcaucuucgggaagacccaggugggcguggggguccagaaggagggcguguuccacaccauguggcacgugacgcggggcgccguccugaccuacaacgggaagcgccucgagccgagcugggccuccgugaagaaggaccugaucagcuacggcgggggcuggcggcuguccgcccaguggcagaagggggaggaggugcaggucaucgcgguggagcccggcaagaaccccaagaacuuccagaccaugcccggcaucuuccagaccacgaccggggagaucggcgccaucgcccuggacuucaagccggggaccagcggcagccccaucaucaaccgcgagggcaagguggucgggcucuacggcaacgggguggugaccaagaacggcggguacgucuccggcaucgcccagacgaacgccgagcccgacggcccgacccccgagcuggaggaggagauguucaagaagcggaaccugaccaucauggaccuccaccccgggagcggcaagacccgcaaguaccugcccgcgaucgugcgggaggccaucaagcgccggcugcgcacgcucauccuggccccgacccggguggucgccgccgagauggaggaggcgcugaaggggcuccccauccgcuaccagaccaccgccacgaaguccgagcacaccggcaaggagaucguggaccugaugugccacgccaccuucaccaugcggcugcucagccccgugcgcguccccaacuacaaccugaucaucauggacgaggcccacuucacggacccggccuccaucgcggcccggggguacaucagcacccgcgugggcaugggcgaggccgccgcgaucuucaugaccgccacgccgcccgggacggccgacgccuucccccaguccaacgccccgauccaggacgaggagcgggacauccccgagcgcagcuggaacuccggcaacgacuggaucaccgacuucgcggggaagaccgugugguucguccccagcaucaaggccggcaacgacaucgccaacugccugcgcaagaacgggaagaaggugauccagcucucccggaagaccuucgacacggaguaccagaagaccaagcugaacgacugggacuucguggucaccaccgacaucagcgagaugggcgccaacuucaaggccgaccgcgugaucgacccccggcgcugccugaagccggugauccucacggacggccccgagcgggucauccuggcggggcccaugcccgugaccguggccuccgccgcccagcgccggggccgcgucgggcggaacccgcagaaggagaacgaccaguacaucuucaccggccagccccugaacaacgacgaggaccacgcccacuggaccgaggcgaagaugcuccuggacaacaucaacacgcccgaggggaucauccccgcccuguucgagccggagcgcgagaaguccgccgccaucgacggcgaguaccggcucaagggcgagagccgcaagaccuucguggagcugaugcggcgcggggaccugcccguguggcucgcgcacaaggucgccagcgagggcaucaaguacaccgaccggaaguggugcuucgacggggagcgcaacaaccagauccuggaggagaacauggacguggagaucuggaccaaggagggcgagaagaagaagcugcggccccgcuggcucgacgcccggaccuacuccgacccccuggcccugaaggaguucaaggacuucgccgcgggccgcaagagcaucgcccucgaccuggucacggagaucgggcgcgugccgucccaccuggcccaccggacccgcaacgcccucgacaaccuggugaugcugcacaccagcgagcacggcgggcgggccuaccgccacgcggucgaggagcuccccgagaccauggagacgcugcugcuccugggccugaugauccuccugaccgggggcgccaugcuguuccucaucagcggcaagggggugggcaagaccuccaucgggcugaucugcguggucgccagcuccggcaugcuguggauggccgacaucccccuccaguggaucgccagcgcgaucgugcuggaguucuucaugauggugcugcucaucccggagcccgagaagcagcggacgccccaggacaaccagcuggccuacgucgugaucgggauccugacgcucgccgccaucguggccgcgaacgagaugggccugcuggagaccaccaagcgcgaccucggcauguccaaggagcccggggucgugccgcccaccagcuaccuggacguggaccugcaccccgccuccgccuggacgcucuacgccgucgcgaccaccgugaucacccccaugcugcggcacacgaucgagaacagcaccgccaacgugucccuggccgccaucgccaaccaggcggucgugcucaugggccuggacaagggguggccgaucagcaagauggaccugggcgugccccuccuggcccuggggugcuacucccaggucaacccccucacccugaccgccgccgugcugcuccuggugacgcacuacgccaucaucggccccggccugcaggcgaaggccacccgcgaggcccagaagcggaccgccgccgggaucaugaagaacccgaccgucgacggcaucaugacgaucgaccucgaccccgugaucuacgacagcaaguucgagaagcagcugggccaggugaugcugcucguccugugcgcggugcagcugcuccugaugcgcaccuccugggccuucugcgaggcccugacccucgccaccggccccaucacgacccugugggagggcagccccgggaaguucuggaacaccaccaucgcgguguccauggccaacaucuuccggggcagcuaccuggccggggccggccucgccuucuccaucaugaaguccgucgggacgggcaagcgcggcaccgggucccagggcgagacccugggggagaaguggaagaagaagcugaaccagcucagccggaaggaguucgaccuguacaagaaguccggcaucaccgagguggaccgcacggaggcgaaggaggggcugaagcggggcgagaucacccaccacgccgugucccgcggcagcgccaagcuccagugguucgucgagcggaacauggugaucccggaggggcgcgugaucgaccugggcugcgggcggggcgggugguccuacuacugcgccggccugaagaaggucaccgaggugcgcggcuacaccaagggcgggcccgggcacgaggagcccgugcccaugagcaccuacggcuggaacaucgucaagcucauguccgggaaggacguguucuaccugccgcccgagaagugcgacacgcugcugugcgacaucggcgagagcucccccagccccaccguggaggagucccggaccauccgcguccucaagaugguggagccguggcugaagaacaaccaguucugcaucaaggugcugaaccccuacaugcccaccgucaucgagcaccucgagcgccugcagcggaagcacggcgggaugcuggugcgcaacccccucagccggaacuccacgcacgagauguacuggaucagcaacggcaccgggaacaucguguccagcgucaacauggugucccgccugcugcucaaccgguucaccaugacccaccgccggccgacgaucgagaaggacguggaccugggcgccggcacccgccacgucaacgcggagcccgagacccccaacauggacgugaucggggagcggauccgccggaucaaggaggagcacagcuccaccuggcacuacgacgacgagaacccguacaagacgugggccuaccacggcagcuacgaggucaaggccaccggguccgccagcagcaugaucaacggcguggugaagcugcucaccaagcccugggacgucgugcccaccgugacgcagauggccaugaccgacaccacccccuucgggcagcagcgcgucuucaaggagaagguggacacgcggaccccgaagcccaugcccggcacccgcaaggugauggagaucaccgcggaguggcuguggcggacgcugggccgcaacaagcggccccgccucugcacccgggaggaguucaccaagaagguccgcaccaacgccgccaugggggccguguucacggaggagaaccagugggacuccgcgcgcgccgccguggaggacgaggaguucuggaagcuggucgaccgggagcgcgagcugcacaagcucggcaagugcgggagcugcguguacaacaugaugggcaagcgggagaagaagcugggggaguucggcaaggccaagggcucccgcgccaucugguacauguggcugggggcgcgguaccucgaguucgaggcccugggcuuccugaacgaggaccacugguucagccgcgagaacuccuacagcgggguggagggcgaggggcuccacaagcugggcuacauccugcgggacaucuccaagaucccgggcggggccauguacgccgacgacaccgccggcugggacacccgcaucaccgaggacgaccuccacaacgaggagaagaucacgcagcagauggaccccgagcaccggcagcuggcgaacgccaucuucaagcugaccuaccagaacaaggucgugaaggugcagcgccccacccccaaggggaccgucauggacaucaucagccggaaggaccagcgcggcuccggccagguggggacguacggccucaacaccuucaccaacauggaggcccagcugauccggcagauggagggggagggcgugcugagcaagaccgaccucgagaacccgcaccuccuggagaagaagaucacccaguggcucgagacgaagggggucgagcgccugaagcggauggccaucuccggcgacgacugcguggugaagcccaucgacgaccgcuucgccaacgcgcugcucgcccugaacgacaugggcaagguccggaaggacaucccccaguggcagcccagcaagggguggcacgacuggcagcaggucccguucugcucccaccacuuccacgagcugaucaugaaggacggccgcaagcucgugguccccugccggccccaggacgagcugaucgggcgcgcccggaucagccagggcgccggguggucccugaaggagaccgccugccucggcaaggcguacgcccagaugugggcccugauguacuuccaccgccgcgaccugcggcucgccagcaacgcgaucugcuccgccgugcccgugcacugggucccgaccagccgcaccacgugguccauccacgcccaccaccaguggaugaccaccgaggacaugcugaccguguggaaccggguguggaucgaggacaaccccuggauggaggacaagacgcccgucaccaccugggaggacgugcccuaccugggcaagcgcgaggaccaguggugcgggagccucaucggccugaccagccgggccacgugggcccagaacauccugaccgcgauccagcagguccgcucccucaucgggaacgaggaguuccuggacuacaugccgagcaugaagcgguuccgcaaggaggaggagcuggagggcgccaucugguga

SEQ ID NO: 9815 - RNA, 9873 nt, Artificial Sequence
  derived and/or modified CDS sequence (opt1) from DENV-3__AB189128__SS-prME
accagccugugccucaugaugauccugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccugaucaccgagguggagcccgaggacaucgacugcuggugcaaccucaccagcaccugggugacguacgggaccugcaaccaggccggcgagcaccggcgcgacaagcgguccgucgcccuggccccccacgugggcauggggcuggacacccgcacccagacguggaugagcgcggagggcgccuggcggcagguggagaaggucgagaccugggccuuccgccacccgggguucaccgugcucgcccuguuccuggcgcacuucaucggcaccucccucacgcagaagguggucaucuucauccugcugaugcucgugacccccagcaugaccaugcggugcgugggggucggcaaccgcgacuucguggagggccuguccggggccaccuggguggacgucgugcuggagcacggcgggugcgugacgaccauggccaagaacaagcccacccucgacaucgagcugcagaagaccgaggccacgcagcuggccacccuccggaagcugugcaucgagggcaagaucaccaacgucaccacggacagccgcugccccacccagggcgaggcgauccugccggaggagcaggaccagaacuacgugugcaagcacaccuacguggaccggggguggggcaacgggugcggccucuucgggaagggcucccuggucaccugcgccaaguuccagugccuggagagcaucgagggcaagguggugcagcacgagaaccucaaguacacggucaucaucaccgugcacaccggggaccagcaccaggucggcaacgagacccagggggugacggccgagaucaccccccaggccuccaccguggaggccauccugcccgaguacggcacccuggggcucgagugcagcccccgcaccggccuggacuucaacgagaugauccugcucacgaugaagaacaaggcguggaugguccaccggcagugguucuucgaccugccgcugcccuggaccuccggcgccaccaccgagacgcccaccuggaacaagaaggagcuccuggugaccuucaagaacgcccacgccaagaagcaggagguggucgugcuggggagccaggagggcgccaugcacaccgcgcucacgggggccaccgagauccagaccuccggcgggaccagcaucuucgccggccaccugaagugccgccugaagauggacaagcucgagcugaagggcauguccuacgccaugugccugaacgccuucgugcucaagaaggaggucagcgagacgcagcacgggaccauccugaucaagguggaguacaagggcgaggacgcgcccugcaagaucccguucagcaccgaggacgggcagggcaaggcccacaacggccggcugaucaccgccaaccccguggucacgaagaaggaggagcccgugaacaucgaggccgagcccccguucggggaguccaacaucgugaucggcaucggggacaaggcgcugaagaucaacugguacaagaagggcagcuccaucgggaagauguucgaggccaccgcccgcggcgcccggcgcauggccauccucggcgacaccgcgugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggccgacaccgggugcgugaucaacuggaagggcaaggagcucaagugcggcuccgggaucuucgucacgaacgaggugcacaccuggaccgagcaguacaaguuccaggcggacagccccaagcggcuggccaccgccaucgccggcgccugggagaacggggugugcggcauccgcuccacgacccgcauggagaaccugcucuggaagcagaucgcgaacgagcugaacuacauccugugggagaacaacaucaagcucaccgucguggugggggacaucaucggcguccuggagcagggcaagcggacccugacgccccagcccaccgagcucaaguacagcuggaagaccugggggaaggccaagaucgugaccgccgagacgcagaacuccagcuucaucaucgacggcccgaacacccccgagugccccuccgccagccgcgcguggaacgugugggaggucgaggaguacggguucggcguguucaccaccaacaucuggcugaagcugcgggagauguacacccagcucugcgaccaccgccugaugagcgccgccgugaaggacgagcgggccguccacgccgacaugggcuacuggaucgagucccagaagaacgggagcuggaagcuggagaaggcgucccucaucgaggugaagacgugcaccuggcccaagagccacacccugugguccaacggcgugcuggagagcgacaugaucaucccgaagucccucgccgggcccaucagccagcacaacuaccgccccggcuaccacacccagacggccgggccguggcaccugggcaagcuggagcucgacuucaacuacugcgagggcaccaccgucgugaucaccgagaacugcgggacgcggggccccucccugcgcaccaccaccgugagcgggaagcugauccacgaguggugcugccgguccugcacgcuccccccccugcgcuacaugggcgaggacgggugcugguacggcauggagauccggccgaucaacgagaaggaggagaacauggucaagagccugguguccgccggcagcgggaagguggacaacuucaccaugggcguccucugccuggccauccuguucgaggaggugaugcgcgggaaguucggcaagaagcacaugaucgcgggggugcucuucaccuucguccugcugcucuccggccagaucaccuggcgggacauggcccgcacgcugaucaugaucggcagcaacgccuccgaccggauggggaugggcgugaccuaccuggcccucaucgccaccuucaagauccagcccuuccuggcgcugggguucuuccuccgcaagcugaccagccgggagaaccugcuccugggcgugggccuggccauggccacgacccuccagcugcccgaggacaucgagcagauggccaacgggaucgcgcugggccucauggcccugaagcugaucacccaguucgagaccuaccagcucuggacggcccuggucagccugaugugcuccaacaccaucuucacccucaccguggccuggcgcacggccacccugauccuggcggggaucagccuccugcccgucugccaguccagcuccaugcggaagaccgacuggcugccgaugaccguggccgccaugggcgugcccccccucccccuguucaucuucagccugaaggacacgcucaagcgccgcuccuggccgcugaacgagggggucauggccgugggccuggugagcauccucgccuccagccugcugcggaacgacguccccauggcgggcccccucguggccgggggccugcugaucgccugcuacgugaucaccgggaccuccgccgaccucaccgucgagaaggccgcgaacgugacgugggaggaggaggccgagcagaccggcgugagccacaaccugaugaucaccgucgacgacgacgggaccaugcgcaucaaggacgacgagaccgagaacauccugacggugcuccugaagaccgcccugcucaucguguccggcaucuuccccuacagcaucccggccacccugcuggucuggcacaccuggcagaagcagacgcagcgguccggcgugcucugggacgugcccagcccccccgagacccagaaggccgagcuggaggacggggucuaccgcaucaagcagcagggcaucuucgggaagacccaggugggcguggggguccagaaggagggcguguuccacaccauguggcacgugacgcggggcgcgguccugacccacaacgggaagcgccucgagccgaacugggccuccgugaagaaggaccugaucagcuacggcgggggcuggcggcuguccgcccaguggcagaagggggaggaggugcaggucaucgccguggagcccggcaagaaccccaagaacuuccagaccaugcccggcaucuuccagaccacgaccggggagaucggcgcgaucgcccuggacuucaagccggggaccagcggcagccccaucaucaaccgcgagggcaagguggucgggcucuacggcaacgggguggugaccaagaacggcggguacgucuccggcaucgcccagacgaacgccgagcccgacggcccgacccccgagcuggaggaggagauguucaagaagcggaaccugaccaucauggaccuccaccccgggagcggcaagacccgcaaguaccugcccgccaucgugcgggaggcgaucaagcgccggcugcgcacgcucauccuggccccgacccggguggucgccgccgagauggaggaggcccugaaggggcuccccauccgcuaccagaccaccgcgacgaaguccgagcacaccggcaaggagaucguggaccugaugugccacgccaccuucaccaugcggcugcucagccccgugcgcguccccaacuacaaccugaucaucauggacgaggcccacuucacggacccggccuccaucgccgcgcggggguacaucagcacccgcgugggcaugggcgaggccgccgccaucuucaugaccgcgaccccccccgggacggccgacgccuucccccaguccaacgccccgauccaggacgaggagcgggacauccccgagcgcagcuggaacuccggcaacgaguggaucaccgacuucgccgggaagaccgugugguucguccccagcaucaaggcgggcaacgacaucgccaacugccugcgcaagaacgggaagaaggugauccagcucucccggaagaccuucgacacggaguaccagaagaccaagcugaacgacugggacuucguggucaccaccgacaucagcgagaugggcgccaacuucaaggccgaccgcgugaucgacccccggcgcugccugaagccggugauccucacggacggccccgagcgggucauccuggccgggcccaugcccgugaccguggcguccgccgcccagcgccggggccgcgucgggcggaacccgcagaaggagaacgaccaguacaucuucaccggccagccccugaacaacgacgaggaccacgcccacuggaccgaggccaagaugcuccuggacaacaucaacacccccgaggggaucauccccgcgcuguucgagccggagcgcgagaagagcgccgccaucgacggcgaguaccggcucaagggcgagucccgcaagacguucguggagcugaugcggcgcggggaccugcccgucuggcucgcccacaagguggcgagcgagggcaucaaguacaccgaccggaaguggugcuucgacggggagcgcaacaaccagauccuggaggagaacauggacguggagaucuggaccaaggagggcgagaagaagaagcugcggccccgcuggcucgacgcccggaccuacuccgacccccuggcccugaaggaguucaaggacuucgccgccggccgcaagagcaucgcgcucgaccuggucacggagaucgggcgcgugccgucccaccuggcccaccggacccgcaacgcccucgacaaccuggugaugcugcacaccagcgagcacggcgggcgggccuaccgccacgccgucgaggagcuccccgagaccauggagacgcugcugcuccugggccugaugauccuccugaccgggggcgcgaugcuguuccucaucagcggcaaggggaucggcaagaccuccaucgggcugaucugcgugguggccagcuccggcaugcuguggauggccgacgucccccuccaguggaucgccagcgccaucgugcuggaguucuucaugauggugcugcucaucccggagcccgagaagcagcggaccccccaggacaaccagcuggcguacgucgugaucgggauccugacgcucgccgccaucguggccgccaacgagaugggccugcuggagaccaccaagcgcgaccucggcauguccaaggagcccggggucgugagcccgaucuccuaccuggacguggaccugcaccccgcgagcgccuggacccucuacgccgucgccacgaccgugaucacccccaugcugcggcacaccaucgagaacuccacggcgaacgugagccuggccgccaucgccaaccaggccgucgugcucaugggccuggacaagggguggcccaucuccaagauggaccugggcgugccgcuccuggcgcuggggugcuacagccaggucaacccccucacccugaccgccgccgugcugcuccuggugacccacuacgccaucaucggccccggccugcaggccaaggcgacgcgcgaggcccagaagcggaccgccgccgggaucaugaagaaccccaccgucgacggcaucaugaccaucgaccucgacccggugaucuacgacuccaaguucgagaagcagcuggggcaggugaugcugcucauccugugcgccguccagcugcuccugaugcgcacgagcugggcguucugcgaggcccugacccucgccaccggccccaucaccacgcugugggagggcucccccgggaaguucuggaacaccaccaucgccgugagcauggcgaacaucuuccggggcuccuaccuggccggggccggccucgccuucagcaucaugaaguccguggggaccggcaagcgcggcacggggagccagggcgagacccugggggagaaguggaagaagaagcugaaccagcucagccggaaggaguucgaccuguacaagaaguccggcaucaccgaggucgaccgcaccgaggccaaggaggggcugaagcggggcgagaucacccaccacgcggugagccgcggcuccgccaagcuccagugguucguggagcggaacauggucauccccgaggggcgcgugaucgaccugggcugcgggcggggcggguggagcuacuacugcgccggccugaagaaggugacggagguccgcggcuacaccaaggggggcccggggcacgaggagcccgugcccauguccaccuacggcuggaacaucgugaagcucaugagcgggaaggacgucuucuaccugcccccggagaagugcgacacccugcugugcgacaucggcgaguccagccccucccccacgguggaggagagccggaccauccgcgugcucaagauggucgagcccuggcugaagaacaaccaguucugcaucaaggugcugaacccguacaugcccaccgugaucgagcaccucgagcgccugcagcggaagcacggcgggaugcugguccgcaacccccucucccggaacagcacccacgagauguacuggaucuccaacggcacggggaacaucgugagcuccgugaacauggucagccgccugcugcucaaccgguucaccaugacccaccgccggcccaccaucgagaaggacguggaccugggcgccggcacgcgccacgucaacgccgagccggagacccccaacauggacgugaucggggagcggauccgccggaucaaggaggagcacuccagcaccuggcacuacgacgacgagaaccccuacaagaccugggcguaccacggcuccuacgaggugaaggccacggggagcgccagcuccaugaucaacggcgucgugaagcugcucaccaagccgugggacgugguccccaccgugacccagauggccaugacggacaccacccccuucgggcagcagcgcguguucaaggagaaggucgacacccggacgccccgcccgaugcccggcacccggaaggugauggagaucaccgccgaguggcuguggcgcacccugggccggaacaagcgcccccggcucugcacgcgcgaggaguucaccaagaaggugcgcaccaacgcggccaugggggccgucuucaccgaggagaaccagugggacagcgcccgggcggccguggaggacgaggaguucuggaagcugguggaccgcgagcgggagcugcacaagcucggcaagugcggguccugcgucuacaacaugaugggcaagcgcgagaagaagcugggggaguucggcaaggccaagggcagccgggccaucugguacauguggcugggggcccgcuaccucgaguucgaggcgcugggcuuccugaacgaggaccacugguucucccgggagaacagcuacuccgggguggagggcgaggggcuccacaagcugggcuacauccugcgcgacaucagcaagauccccggcggggccauguacgccgacgacacggccggcugggacacccggaucaccgaggacgaccuccacaacgaggagaagaucacccagcagauggacccggagcaccgccagcuggccaacgcgaucuucaagcugacguaccagaacaagguggucaaggugcagcggcccacccccaaggggaccgugauggacaucaucucccgcaaggaccagcggggcagcggccaggucgggaccuacggccucaacaccuucacgaacauggaggcccagcugauccgccagauggagggggagggcgugcuguccaaggccgaccucgagaacccccaccugcuggagaagaagaucacccaguggcucgaggccgaggggguggagcggcugaagcgcauggccaucagcggcgacgacugcgucgugaagccgaucgacgaccgguucgcgaacgcccugcucgcccugaacgacaugggcaaggugcgcaaggacaucccccaguggcagcccuccaagggguggcacgacuggcagcagguccccuucugcagccaccacuuccacgagcugaucaugaaggacggccggaagcucguggugccgugccgcccccaggacgagcugaucgggcgggcccgcaucucccagggcgccggguggagccugaaggagaccgcgugccucggcaaggccuacgcccagaugugggcccugauguacuuccaccgccgggaccugcgccucgcguccaacgccaucugcagcgccguccccgugcacugggugcccaccucccggacgaccuggagcauccacgcccaccaccaguggaugaccaccgaggacaugcugacggucuggaaccgcguguggaucgaggacaacccguggauggaggacaagacccccgugaccaccugggaggacguccccuaccugggcaagcgggaggaccaguggugcgggagccucaucggccacacgucccgcgccaccugggcgcagaacauccugaccgccauccagcaggugcggagccugaucgggaacgaggaguuccucgacuacaugcccuccaugaagcgcuuccggaaggaggaggagagcgagggcgccaucugguga

SEQ ID NO: 9816 - RNA, 9873 nt, Artificial Sequence
  derived and/or modified CDS sequence (opt1) from DENV-3__AB214879__SS-prME
accagccugugccucaugaugaugcugcccgccacccuggccuuccaccucaccagccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagacguggaugagcgcggagggcgccuggcgccagguggagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggucgugcagcacgagaaccucaaguacacggugaucaucaccguccacaccggggaccagcaccaggugggcaacgagacccagggggucacggccgagaucacgccccaggccuccaccguggaggccgugcugcccgaguacggcacccuggggcucgagugcagcccccgcaccggccuggacuucaacgagaugauccugcucacgaugaagaacaaggcguggaugguccaccggcagugguucuucgaccugccgcugcccuggaccuccggcgccaccaccgagacgcccaccuggaacaagaaggagcuccuggugaccuucaagaacgcccacgccaagaagcaggagguggucgugcuggggagccaggagggcgccaugcacaccgcgcucacgggggccaccgagauccagaccuccggcgggaccagcguguucgccggccaccugaagugccgccugaagauggacaagcucgagcugaagggcauguccuacgccaugugcagcaacgccuucguccugaagaaggaggugagcgagacgcagcacgggaccauccucaucaagguggaguacaagggcgaggacgcgcccugcaagaucccguucuccaccgaggacgggcagggcaaggcccacaacggccggcugaucaccgccaaccccgucgugacgaagaaggaggagcccgugaacaucgaggccgagcccccguucggggagagcaacaucaucaucggcaucggggacaaggcgcugaagaucaacugguacaagaagggcuccagcaucgggaagauguucgaggccaccgcccgcggcgcccggcgcauggccauccugggcgacaccgcgugggacuucggguccgucggcggggugcucaacagccugggcaagauggugcaccagaucuucggguccgccuacaccgcccuguucagcggcgucuccuggaucaugaagaucggcaucggggugcuccugacguggaucggccugaacagcaagaacaccuccaugagcuucuccugcaucgugaucgggaucaucacccucuaccugggcgccgucgugcaggccgacauggggugcgugaucaacuggaagggcaaggagcugaagugcggcagcgggaucuucgucaccaacgaggugcacacguggaccgagcaguacaaguuccaggcggacucccccaagcggcucgccaccgccaucgccggcgccugggagaacggggugugcggcauccgcagcaccacgcgcauggagaaccugcuguggaagcagaucgcgaacgagcucaacuacauccugugggagaacaacaucaagcugaccgucguggugggggacaucaucggcguccucgagcagggcaagcggacccugacgccccagcccauggagcugaaguacuccuggaagacgugggggaaggccaagaucgugaccgccgagacccagaacagcuccuucaucaucgacggcccgaacacccccgagugccccagcgccagccgcgcguggaacgugugggaggucgaggacuacggguucggcguguucacgaccaacaucuggcucaagcugcgggagauguacacccagcugugcgaccaccgccucauguccgccgccgugaaggacgagcgggccguccacgccgacaugggcuacuggaucgagagccagaagaacggguccuggaagcuggagaaggcgagccugaucgaggugaagaccugcaccuggcccaagucccacacgcucuggagcaacggcgugcuggaguccgacaugaucauccccaagagccuggccgggcccaucucccagcacaacuaccgccccggcuaccacacccagaccgccgggccguggcaccucggcaagcuggagcuggacuucaacuacugcgagggcaccacggucgugaucaccgagaacugcgggacccggggccccagccuccgcaccacgaccguguccgggaagcugauccacgaguggugcugccggagcugcacccugccgccccugcgcuacaugggcgaggacgggugcugguacggcauggagauccggccgaucaacgagaaggaggagaacauggucaagucccuggugagcgccggcuccgggaagguggacaacuucaccaugggcguccugugccucgccauccuguucgaggaggugaugcgcgggaaguucggcaagaagcacaugaucgcgggggugcuguucacguucguccuccugcugagcggccagaucaccuggcgggacauggcccgcacccucaucaugaucggcuccaacgccagcgaccggauggggaugggcgugaccuaccuggcccugaucgccacguucaagauccagcccuuccucgcgcugggguucuuccugcgcaagcucaccagccgggagaaccugcugcucggcgugggccuggccauggccaccacccugcagcuccccgaggacaucgagcagauggccaacgggaucgcgcugggccugauggcccucaagcugaucacgcaguucgagaccuaccagcuguggaccgcccucaccucccugaugugcagcaacacgaucuucacccugaccgucgccuggcgcaccgccacgcucauccuggcggggaucucccugcuccccgugugccagagcuccagcaugcggaagaccgacuggcugccgaugaccgucgccgccaugggcgugccgccccucccccucuucaucuucucccugaaggacacccugaagcgccgcagcuggccgcucaacgagggggugauggccgucggccugguguccauccuggccagcucccuccugcggaacgacgugcccauggcgggcccccuggucgccgggggccuccugaucgccugcuacgugaucacggggaccagcgccgaccugaccguggagaaggccgcggacgucaccugggaggaggaggccgagcagacgggcgugucccacaaccucaugaucaccguggacgacgacgggaccaugcgcaucaaggacgacgagaccgagaacauccugaccguccugcucaagacggcccugcugaucgugagcggcaucuuccccuacuccaucccggccacccuccugguguggcacaccuggcagaagcagacccagcggagcggcguccugugggacgugcccagcccgcccgagacgcagaaggccgagcucgaggaggggguguaccgcaucaagcagcagggcaucuucgggaagacccaggucggcgugggggugcagaaggagggcgucuuccacaccauguggcacgugacccggggcgcggugcugacgcacaacgggaagcgccuggagccgaacugggccagcgucaagaaggaccucaucuccuacggcgggggcuggcggcugagcgcccaguggcagaagggggaggagguccaggugaucgccgucgagcccggcaagaaccccaagaacuuccagaccaugcccggcaucuuccagaccaccacgggggagaucggcgcgaucgcccuggacuucaagccggggaccagcggcucccccaucaucaaccgcgagggcaaggugguggggcuguacggcaacggggucgugaccaagagcggcggguacguguccggcaucgcccagaccaacgccgagcccgacggcccgacgcccgagcucgaggaggagauguucaagaagcggaaccugaccaucauggaccugcaccccgggagcggcaagacccgcaaguaccuccccgccaucguccgggaggcgaucaagcgccggcugcgcacccugauccucgccccgacgcgggugguggccgccgagauggaggaggcccugaaggggcugcccauccgcuaccagaccaccgcgaccaaguccgagcacacgggcaaggagaucgucgaccucaugugccacgccaccuucaccaugcggcugcugagccccgugcgcgugcccaacuacaaccucaucaucauggacgaggcccacuucaccgacccggccuccaucgccgcgcggggguacaucagcacgcgcgucggcaugggcgaggccgccgccaucuucaugaccgcgacgccgcccgggaccgccgacgccuucccccaguccaacgccccgauccaggacgaggagcgggacauccccgagcgcagcuggaacuccggcaacgacuggaucacggacuucgccgggaagaccgugugguucgugcccagcaucaaggcgggcaacgacaucgccaacugccugcgcaagaacgggaagaaggucauccagcugucccggaagaccuucgacaccgaguaccagaagacgaagcucaacgacugggacuucguggugaccaccgacaucagcgagaugggcgccaacuucaaggccgaccgcgucaucgacccccggcgcugccugaagccggugauccugaccgacggccccgagcgggugauccucgccgggcccaugcccgucacgguggcguccgccgcccagcgccggggccgcguggggcggaacccgcagaaggagaacgaccaguacaucuucaccggccagccccugaacaacgacgaggaccacgcccacuggaccgaggccaagaugcugcucgacaacaucaacacccccgaggggaucauccccgcgcuguucgagccggagcgcgagaaguccgccgccaucgacggcgaguaccggcugaagggcgagucccgcaagaccuucgucgagcucaugcggcgcggggaccugcccguguggcuggcccacaaggucgcgagcgagggcaucaaguacacggaccggaaguggugcuucgacggggagcgcaacaaccagauccucgaggagaacauggacguggagaucuggaccaaggagggcgagaagaagaagcugcggccccgcuggcuggacgcccggaccuacuccgacccccucgcccugaaggaguucaaggacuucgccgccggccgcaagagcaucgcguucgaccuggugaccgagaucgggcgcgucccgagccaccucgcccaccggacgcgcaacgcccuggacaaccuggugaugcuccacaccuccgagcacggcgggcgggccuaccgccacgccguggaggagcugcccgagaccauggagacccugcuccugcugggccucaugauccugcugaccggcggggcgaugcuguuccugaucagcgggaaggggaucggcaagaccuccaucgggcugaucugcgucguggccagcuccggcaugcucuggauggccgacaucccccugcaguggaucgccagcgccaucgugcuggaguucuucaugaugguccuccugaucccggagcccgagaagcagcggacgccccaggacaaccagcuggcguacguggugaucgggauccucacccuggccgccaucgucgccgccaacgagaugggccugcucgagacgaccaagcgcgaccugggcauguccaaggagcccgggguggugagcccgaccuccuaccuggacgucgaccuccaccccgcgagcgccuggacccuguacgccguggccacgaccgugaucacccccaugcugcggcacaccaucgagaacuccacggcgaacgucagccucgccgccaucgccaaccaggccguggugcugaugggccuggacaagggguggcccaucuccaagauggaccucggcgucccgcugcuggcgcucgggugcuacagccaggugaacccccugacccugaccgccgccgugcuccugcuggucacccacuacgccaucaucggccccggccuccaggccaaggcgacgcgcgaggcccagaagcggaccgccgccgggaucaugaagaaccccaccguggacggcaucaugaccaucgaccuggacccggugaucuacgacuccaaguucgagaagcagcuggggcaggucaugcuccuggugcugugcgccgugcagcuccugcugaugcgcacgagcugggcguucugcgaggcccucacccuggccaccggccccaucaccacgcugugggagggcucccccgggaaguucuggaacaccaccaucgccgucagcauggcgaacaucuuccggggcuccuaccucgccggggccggccuggccuucagcaucaugaaguccguggggaccggcaagcgcggcacggggucccagggcgagacccugggggagaaguggaagaagaagcucaaccagcugagccggaaggaguucgaccuguacaagaaguccggcaucaccgagguggaccgcaccgaggccaaggaggggcucaagcggggcgagaucacccaccacgcggucagccgcggcuccgccaagcugcagugguucguggagcggaacauggugauccccgaggggcgcgucaucgaccugggcugcgggcggggcggguggagcuacuacugcgccggccucaagaaggugacggaggugcgcggcuacaccaagggcggcccggggcacgaggagcccguccccauguccaccuacggcuggaacaucgugaagcugaugagcgggaaggacguguucuaccugcccccggagaagugcgacacccuccugugcgacaucggcgaguccagccccucccccacggucgaggagagccggaccauccgcgugcugaagaugguggagcccuggcugaagaacaaccaguucugcaucaagguccucaacccguacaugcccaccgugaucgagcaccuggagcgccugcagcggaagcacggcgggaugcucgugcgcaacccccugucccggaacagcacccacgagauguacuggaucuccaacggcacggggaacaucgucagcuccgugaacauggugagccgccugcuccugaaccgguucaccaugaccuaccgccggcccaccaucgagaaggacgucgaccugggcgccggcacgcgccacgugaacgccgagccggagacccccaacauggacgucaucggggagcggauccgccggaucaaggaggagcacuccagcaccuggcacuacgacgacgagaaccccuacaagaccugggcguaccacggcagcuacgaggugaaggccacgggguccgccagcuccaugaucaacggcguggucaagcuccugaccaagccgugggacguggugcccaccgucacccagauggccaugacggacaccacccccuucgggcagcagcgcguguucaaggagaagguggacacccggacgcccaagccgaugcccggcacccgcaaggucauggagaucaccgccgaguggcuguggcggacccucggccgcaacaagcggccccgccugugcacgcgggaggaguucaccaagaaggugcgcaccaacgcggccaugggggccguguucaccgaggagaaccagugggacagcgcccgcgcggccgucgaggacgaggaguucuggaagcugguggaccgggagcgcgagcuccacaagcugggcaagugcggguccugcguguacaacaugaugggcaagcgggagaagaagcugggggaguucggcaaggccaagggcagccgcgccaucugguacauguggcucggggcccgguaccuggaguucgaggcgcugggcuuccucaacgaggaccacugguucucccgcgagaacagcuacuccggggucgagggcgaggggcugcacaagcugggcuacauccuccgggacaucagcaagauccccggcggggccauguacgccgacgacacggccggcugggacacccgcaucaccgaggacgaccugcacaacgaggagaagaucacccagcagauggacccggagcaccggcagcuggccaacgcgaucuucaagcucacguaccagaacaagguggugaagguccagcgccccacccccaaggggaccgugauggacaucaucucccggaaggaccagcgcggcagcggccagguggggaccuacggccugaacaccuucacgaacauggaggcccagcugauccggcagauggagggggagggcguccucuccaagaccgaccuggagaacccccaccuccucgagaagcgcaucacccaguggcuggagaccaaggggguggagcggcugaagcgcauggccaucagcggcgacgacugcguggucaagccgaucgacgaccgguucgccaacgcccuccuggcgcugaacgacaugggcaaggugcgcaaggacaucccccaguggcagcccuccaagggguggcacgacuggcagcagguccccuucugcagccaccacuuccacgagcucaucaugaaggacggccggaagcuggucgugccgugccgcccccaggacgagcugaucgggcgggcccgcaucucccagggcgccggguggagccucaaggagacggccugccugggcaaggccuacgcgcagaugugggcccugauguacuuccaccgccgggaccuccgccuggccuccaacgccaucugcagcgcggugcccguccacugggugcccaccagccggaccaccugguccauccacgcccaccaccaguggaugacgaccgaggacaugcugaccguguggaaccgcgucuggaucgaggacaacccguggauggaggacaagacccccgugacgaccugggaggacgugcccuaccucggcaagcgggaggaccaguggugcgggagccugaucggccugaccucccgcgccaccugggcccagaacauccucacggccauccagcagguccggagccugaucgggaacgaggaguuccuggacuacaugcccuccaugaagcgcuuccggaaggaggaggagagcgagggcgcgaucugguga

SEQ ID NO: 9817 - RNA, 9873 nt, Artificial Sequence
  derived and/or modified CDS sequence (opt1) from DENV-3__AB214880__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccugaucaccgagguggagcccgaggacaucgacugcuggugcaaccucaccagcaccugggugacguacgggaccugcaaccaggccggcgagcaccggcgcgacaagcgguccgucgcccuggccccccacgugggcauggggcuggacacccgcacccagacguggaugagcgcggagggcgccuggcggcagguggagaaggucgagaccugggccuuccgccacccgggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugccggaggagcaggaccagaacuacgucugcaagcacaccuacguggaccggggguggggcaacgggugcggccucuucgggaagggcucccuggugaccugcgccaaguuccagugccuggagagcaucgagggcaaggucgugcagcacgagaaccucaaguacacggugaucaucaccguccacaccggggaccagcaccaggugggcaacgagacccagggggucacggccgagaucaccccccaggccuccaccguggaggccgugcugcccgaguacggcacccuggggcucgagugcagcccccgcaccggccuggacuucaacgagaugauccugcucacgaugaagaacaaggcguggaugguccaccggcagugguucuucgaccugccgcugcccuggaccuccggcgccaccaccgagacgcccaccuggaacaagaaggagcuccuggugaccuucaagaacgcccacgccaagaagcaggagguggucgugcuggggagccaggagggcgccaugcacaccgcgcucacgggggccaccgagauccagaccuccggcgggaccagcaucuucgccggccaccugaagugccgccugaagauggacaagcucgagcugaagggcauguccuacgccaugugcagcaacgccuucgugcugaagaaggaggucagcgagacgcagcacgggaccauccucaucaagguggaguacaagggcgaggacgcgcccugcaagaucccguucuccaccgaggacgggcagggcaaggcccacaacggccggcugaucaccgccaaccccguggucacgaagaaggaggagcccgugaacaucgaggccgagcccccguucggggagagcaacaucaucaucggcaucggggacaaggcgcugaagaucaacugguacaagaagggcuccagcaucgggaagauguucgaggccaccgcccgcggcgcccggcgcauggccauccugggcgacaccgcgugggacuucggguccgugggcgggguccucaacagccugggcaagauggugcaccagaucuucggguccgccuacaccgcccuguucagcggcguguccuggaucaugaagaucggcaucgggguccuccugacguggaucggccugaacagcaagaacaccuccaugagcuucuccugcaucgugaucgggaucaucacccucuaccugggcgccgugguccaggccgacauggggugcgugaucaacuggaagggcaaggagcugaagugcggcagcgggaucuucgugaccaacgagguccacacguggaccgagcaguacaaguuccaggcggacucccccaagcggcucgccaccgccaucgccggcgccugggagaacggggugugcggcauccgcagcaccacgcgcauggagaaccugcuguggaagcagaucgcgaacgagcucaacuacauccugugggagaacaacaucaagcugaccguggucgugggggacaucaucggcgugcucgagcagggcaagcggacccugaccccccagcccauggagcugaaguacuccuggaagacgugggggaaggccaagaucgucaccgccgagacccagaacagcuccuucaucaucgacggcccgaacacccccgagugccccagcgccagccgcgcguggaacgugugggagguggaggacuacggguucggcgucuucacgaccaacaucuggcucaagcugcgggagauguacacccagcugugcgaccaccgccucauguccgccgccgugaaggacgagcgggccgugcacgccgacaugggcuacuggaucgagagccagaagaacggguccuggaagcuggagaaggcgagccugaucgaggucaagaccugcaccuggcccaagucccacacgcucuggagcaacggcgugcuggaguccgacaugaucaucccgaagagccuggccgggcccaucucccagcacaacuaccgccccggcuaccacacccagaccgccgggccguggcaccucggcaagcuggagcuggacuucaacuacugcgagggcaccacgguggucaucaccgagaacugcgggacccggggccccagccuccgcaccacgaccguguccgggaagcugauccacgaguggugcugccggagcugcacccugcccccccuccgcuacaugggcgaggacgggugcugguacggcauggagauccggccgaucaacgagaaggaggagaacauggugaagucccuggucagcgccggcuccgggaagguggacaacuucaccaugggcgugcugugccucgccauccuguucgaggaggucaugcgcgggaaguucggcaagaagcacaugaucgcgggggugcuguucacguucgugcuccugcugagcggccagaucaccuggcgggacauggcccgcacccucaucaugaucggcuccaacgccagcgaccggauggggaugggcgucaccuaccuggcccugaucgccacguucaagauccagcccuuccucgcgcugggguucuuccugcgcaagcucaccagccgggagaaccugcugcucggcgugggccuggccauggccaccacccugcagcuccccgaggacaucgagcagauggccaacgggaucgcgcugggccugauggcccucaagcugaucacgcaguucgagaccuaccagcuguggaccgcccucgccucccugaugugcagcaacaccaucuucacgcugaccguggccuggcgcaccgcgacccucauccuggccgggaucucccugcuccccgucugccagagcuccagcaugcggaagacggacuggcugccgaugaccguggccgccaugggcguccccccccugccccucuucaucuucucccugaaggacacccugaagcgccgcagcuggccgcucaacgagggggugauggccgugggccuggucuccauccuggcgagcucccuccugcggaacgacgugcccauggccggcccccugguggccgggggccuccugaucgccugcuacgucaucaccgggacgagcgccgaccugaccguggagaaggcggccgacgugaccugggaggaggaggccgagcagaccggcgucucccacaaccucaugaucacgguggacgacgacgggaccaugcgcaucaaggacgacgagaccgagaacauccugaccgugcugcucaagaccgcccugcugaucgucagcggcaucuuccccuacuccaucccggccacgcuccugguguggcacaccuggcagaagcagacccagcggagcggcgugcugugggacguccccuccccccccgagacccagaaggcggagcucgaggaggggguguaccgcaucaagcagcagggcaucuucgggaagacgcaggugggcgucggggugcagaaggagggcguguuccacaccauguggcacgucacccggggcgccgugcugacccacaacgggaagcgccuggagccgaacugggccagcgugaagaaggaccucaucuccuacggcgggggcuggcggcugagcgcccaguggcagaagggggaggagguccaggugaucgcgguggagcccggcaagaaccccaagaacuuccagacgaugcccggcaucuuccagaccaccaccggggagaucggcgccaucgcccuggacuucaagccggggacgagcggcucccccaucaucaaccgcgagggcaaggucguggggcuguacggcaacgggguggucaccaagagcggcggguacguguccggcaucgcccagaccaacgccgagcccgacggcccgacccccgagcucgaggaggagauguucaagaagcggaaccugacgaucauggaccugcaccccgggagcggcaagacccgcaaguaccuccccgcgaucgugcgggaggccaucaagcgccggcugcgcacccugauccucgccccgacccgggucguggccgccgagauggaggaggcgcugaaggggcugcccauccgcuaccagacgaccgccaccaaguccgagcacaccggcaaggagaucguggaccucaugugccacgccacguucaccaugcggcugcugagccccguccgcgugcccaacuacaaccucaucaucauggacgaggcccacuucaccgacccggccuccaucgcggcccggggguacaucagcacccgcgugggcaugggcgaggccgccgcgaucuucaugacggccaccccccccgggaccgccgacgccuucccccaguccaacgccccgauccaggacgaggagcgggacauccccgagcgcagcuggaacuccggcaacgacuggaucaccgacuucgcggggaagacggucugguucgugcccagcaucaaggccggcaacgacaucgccaacugccugcgcaagaacgggaagaaggugauccagcugucccggaagaccuucgacaccgaguaccagaagaccaagcucaacgacugggacuucgucgugacgaccgacaucagcgagaugggcgccaacuucaaggccgaccgcgugaucgacccccggcgcugccugaagccggucauccugaccgacggccccgagcgggugauccucgcggggcccaugcccgugaccgucgccuccgccgcccagcgccggggccgcguggggcggaacccgcagaaggagaacgaccaguacaucuucacgggccagccccugaacaacgacgaggaccacgcccacuggaccgaggcgaagaugcugcucgacaacaucaacacccccgaggggaucauccccgcccuguucgagccggagcgcgagaagagcgccgccaucgacggcgaguaccggcugaagggcgagucccgcaagaccuucguggagcucaugcggcgcggggaccugcccgucuggcuggcgcacaagguggccagcgagggcaucaaguacaccgaccggaaguggugcuucgacggggagcgcaacaaccagauccucgaggagaacauggacgucgagaucuggacgaaggagggcgagaagaagaagcugcggccccgcuggcuggacgcccggaccuacuccgacccccucgcccugaaggaguucaaggacuucgccgcgggccgcaagagcaucgccuucgaccuggugaccgagaucgggcgcgugccgagccaccucgcccaccggacccgcaacgcccuggacaaccuggucaugcuccacacguccgagcacggcgggcgggccuaccgccacgcgguggaggagcugcccgagaccauggagacccugcuccugcugggccucaugauccugcugaccgggggcgccaugcucuuccugaucagcggcaaggggaucggcaagacguccaucgggcugaucugcguggucgccagcuccggcaugcucuggauggccgacaucccccugcaguggaucgccagcgcgaucgugcuggaguucuucaugauggugcuccugaucccggagcccgagaagcagcggaccccccaggacaaccagcuggccuacgucgugaucgggauccucacccuggccgccaucguggccgcgaacgagaugggccugcucgagaccacgaagcgcgaccugggcauguccaaggagcccggggucgugagcccgaccuccuaccuggacguggaccuccaccccgccagcgccuggacccuguacgccgucgcgaccacggugaucacccccaugcugcggcacaccaucgagaacuccaccgccaacgugagccucgccgccaucgccaaccaggcggucgugcugaugggccuggacaagggguggcccaucuccaagauggaccucggcgugccgcugcuggcccucgggugcuacagccaggucaacccccugacgcugaccgccgccgugcuccugcuggugacccacuacgccaucaucggccccggccuccaggcgaaggccacccgcgaggcccagaagcggacggccgccgggaucaugaagaaccccaccgucgacggcaucaugaccaucgaccuggacccggugaucuacgacuccaaguucgagaagcagcuggggcaggugaugcuccugguccugugcgcggugcagcuccugcugaugcgcaccagcugggccuucugcgaggcccucacgcuggccaccggccccaucaccacccugugggagggcucccccgggaaguucuggaacacgaccaucgcggugagcauggccaacaucuuccggggcuccuaccucgccggggccggccuggccuucagcaucaugaagagcgucgggaccggcaagcgcggcaccgggucccagggcgagacgcugggggagaaguggaagaagaagcucaaccagcugagccggaaggaguucgaccuguacaagaaguccggcaucaccgagguggaccgcaccgaggcgaaggaggggcucaagcggggcgagaucacccaccacgccgugagccgcggcuccgccaagcugcagugguucgucgagcggaacauggugauccccgaggggcgcgugaucgaccugggcugcgggcggggcggguggagcuacuacugcgccggccucaagaaggucaccgaggugcgcggcuacacgaaggggggcccggggcacgaggagcccgugcccauguccaccuacggcuggaacaucgucaagcugaugagcgggaaggacguguucuaccugcccccggagaagugcgacacccuccugugcgacaucggcgaguccagccccucccccaccguggaggagagccggacgauccgcguccugaagaugguggagcccuggcugaagaacaaccaguucugcaucaaggugcucaacccguacaugcccaccgucaucgagcaccuggagcgccugcagcggaagcacggcgggaugcucgugcgcaacccccugucccggaacagcacccacgagauguacuggaucuccaacggcaccgggaacaucgugagcuccgucaacauggugagccgccugcuccugaaccgguucacgaugaccuaccgccggcccaccaucgagaaggacguggaccugggcgccggcacccgccacgucaacgcggagccggagacgcccaacauggacgugaucggggagcggauccgccggaucaaggaggagcacuccagcaccuggcacuacgacgacgagaaccccuacaagaccugggccuaccacggcagcuacgaggucaaggccaccggguccgccagcuccaugaucaacggcguggugaagcuccugacgaagccgugggacgucgugcccaccgugacccagauggccaugaccgacacgacccccuucgggcagcagcgcgucuucaaggagaagguggacacccggacccccaagccgaugcccggcacgcgcaaggugauggagaucaccgcggaguggcuguggcggacccucggccgcaacaagcggccccgccugugcacccgggaggaguucacgaagaagguccgcaccaacgccgccaugggggccguguucaccgaggagaaccagugggacagcgcgcgcgccgccguggaggacgaggaguucuggaagcuggucgaccgggagcgcgagcuccacaagcugggcaagugcggguccugcguguacaacaugaugggcaagcgggagaagaagcugggggaguucggcaaggccaagggcagccgcgccaucugguacauguggcucggggcgcgguaccuggaguucgaggcccugggcuuccucaacgaggaccacugguucucccgcgagaacagcuacuccgggguggagggcgaggggcugcacaagcugggcuacauccuccgggacaucagcaagauccccggcggggccauguacgccgacgacaccgccggcugggacacgcgcaucaccgaggacgaccugcacaacgaggagaagaucacccagcagauggacccggagcaccggcagcuggcgaacgccaucuucaagcucaccuaccagaacaaggucgugaaggugcagcgccccacgcccaaggggaccgucauggacaucaucucccggaaggaccagcgcggcagcggccagguggggaccuacggccugaacaccuucaccaacauggaggcccagcugauccggcagauggagggggagggcgugcucuccaagacggaccuggagaacccccaccugcucgagaagcgcaucacccaguggcuggagaccaagggggucgagcggcugaagcgcauggccaucagcggcgacgacugcguggugaagccgaucgacgaccgguucgccaacgcgcuccuggcccugaacgacaugggcaagguccgcaaggacaucccccaguggcagcccuccaagggguggcacgacuggcagcaggugcccuucugcagccaccacuuccacgagcucaucaugaaggacggccggaagcugguggucccgugccgcccccaggacgagcugaucgggcgggcccgcaucucccagggcgccggguggagccucaaggagaccgccugccugggcaaggcguacgcccagaugugggcccugauguacuuccaccgccgggaccuccgccuggccuccaacgcgaucugcagcgccgugcccgugcacuggguccccacgagccggaccaccugguccauccacgcccaccaccaguggaugaccacggaggacaugcugaccguguggaaccgcguguggaucgaggacaacccguggauggaggacaagacccccgucaccacgugggaggacgugcccuaccucggcaagcgggaggaccaguggugcgggagccugaucggccugaccucccgcgccaccugggcccagaacauccucaccgcgauccagcaggugcggagccugaucgggaacgaggaguuccuggacuacaugcccuccaugaagcgcuuccggaaggaggaggagagcgagggcgccaucugguga

SEQ ID NO: 9818 - RNA, 9873 nt, Artificial Sequence
  derived and/or modified CDS sequence (opt1) from DENV-3__AB214881__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccugaucaccgagguggagcccgaggacaucgacugcuggugcaaccucaccagcaccugggugacguacgggaccugcaaccaggccggcgagcaccggcgcgacaagcgguccgucgcccuggccccccacgugggcauggggcuggacacccgcacccagacguggaugagcgcggagggcgccuggcggcagguggagaaggucgagaccugggccuuccgccacccgggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugccggaggagcaggaccagaacuacgucugcaagcacaccuacguggaccggggguggggcaacgggugcggccucuucgggaagggcucccuggugaccugcgccaaguuccagugccuggagagcaucgagggcaaggucgugcagcacgagaaccucaaguacacggugaucaucaccguccacaccggggaccagcaccaggugggcaacgagacccagggggucacggccgagaucaccccccaggccuccaccguggaggccgugcugcccgaguacggcacccuggggcucgagugcagcccccgcaccggccuggacuucaacgagaugauccugcucacgaugaagaacaaggcguggaugguccaccggcagugguucuucgaccugccgcugcccuggaccuccggcgccaccaccgagacgcccaccuggaacaagaaggagcuccuggugaccuucaagaacgcccacgccaagaagcaggagguggucgugcuggggagccaggagggcgccaugcacaccgcgcucacgggggccaccgagauccagaccuccggcgggaccagcaucuucgccggccaccugaagugccgccugaagauggacaagcucgagcugaagggcauguccuacgccaugugcagcaacgccuucgugcugaagaaggaggucagcgagacgcagcacgggaccauccucaucaagguggaguacaagggcgaggacgcgcccugcaagaucccguucuccaccgaggacgggcagggcaaggcccacaacggccggcugaucaccgccaaccccguggucacgaagaaggaggagcccgugaacaucgaggccgagcccccguucggggagagcaacaucaucaucggcaucggggacaaggcgcugaagaucaacugguacaagaagggcuccagcaucgggaagauguucgaggccaccgcccgcggcgcccggcgcauggccauccugggcgacaccgcgugggacuucggguccgugggcgggguccucaacagccugggcaagauggugcaccagaucuucggguccgccuacaccgcccuguucagcggcguguccuggaucaugaagaucggcaucgggguccuccugacguggaucggccugaacagcaagaacaccuccaugagcuucuccugcaucgugaucgggaucaucacccucuaccugggcgccgugguccaggccgacauggggugcgugaucaacuggaagggcaaggagcugaagugcggcagcgggaucuucgugaccaacgagguccacacguggaccgagcaguacaaguuccaggcggacucccccaagcggcucgccaccgccaucgccggcgccugggagaacggggugugcggcauccgcagcaccacgcgcauggagaaccugcuguggaagcagaucgcgaacgagcucaacuacauccugugggagaacaacaucaagcugaccguggucgugggggacaucaucggcauccucgagcagggcaagcggacccugaccccccagcccauggagcugaaguacuccuggaagacgugggggaaggccaagaucgugaccgccgagacccagaacagcuccuucaucaucgacggcccgaacacccccgagugccccagcgccagccgcgcguggaacgucugggagguggaggacuacggguucggcguguucacgaccaacaucuggcucaagcugcgggagauguacacccagcugugcgaccaccgccucauguccgccgccgucaaggacgagcgggccgugcacgccgacaugggcuacuggaucgagagccagaagaacggguccuggaagcuggagaaggcgagccugaucgaggugaagaccugcaccuggcccaagucccacacgcucuggagcaacggcguccuggaguccgacaugaucaucccgaagagccuggccgggcccaucucccagcacaacuaccgccccggcuaccacacccagaccgccgggccguggcaccucggcaagcuggagcuggacuucaacuacugcgagggcaccacgguggugaucaccgagaacugcgggacccggggccccagccuccgcaccacgaccgucuccgggaagcugauccacgaguggugcugccggagcugcacccugcccccccuccgcuacaugggcgaggacgggugcugguacggcauggagauccggccgaucaacgagaaggaggagaacauggugaagucccuggugagcgccggcuccgggaaggucgacaacuucaccaugggcgugcugugccucgccauccuguucgaggaggugaugcgcgggaaguucggcaagaagcacaugaucgcggggguccuguucacguucgugcuccugcugagcggccagaucaccuggcgggacauggcccgcacccucaucaugaucggcuccaacgccagcgaccggauggggaugggcgugaccuaccuggcccugaucgccacguucaagauccagcccuuccucgcgcugggguucuuccugcgcaagcucaccagccgggagaaccugcugcucggcgucggccuggccauggccaccacccugcagcuccccgaggacaucgagcagauggccaacgggaucgcgcugggccugauggcccucaagcugaucacgcaguucgagaccuaccagcuguggaccgcccucgccucccugaugugcagcaacaccaucuucacgcugaccguggccuggcgcaccgcgacccucauccuggccgggaucucccugcuccccgugugccagagcuccagcaugcggaagacggacuggcugccgaugaccgucgccgccaugggcgugcccccccugccccucuucaucuucucccugaaggacacccugaagcgccgcagcuggccgcucaacgagggggucauggccgugggccugguguccauccuggcgagcucccuccugcggaacgacguccccauggccggcccccugguggccgggggccuccugaucgccugcuacgugaucaccgggacgagcgccgaccugaccgucgagaaggcggccgacgugaccugggaggaggaggccgagcagaccggcgugucccacaaccucaugaucacggucgacgacgacgggaccaugcgcaucaaggacgacgagaccgagaacauccugaccgugcugcucaagaccgcccugcugaucgugagcggcaucuuccccuacuccaucccggccacgcuccuggucuggcacaccuggcagaagcagacccagcggagcggcgugcugugggacgugcccuccccccccgagacccagaaggcggagcucgaggagggggucuaccgcaucaagcagcagggcaucuucgggaagacgcaggugggcguggggguccagaaggagggcguguuccacaccauguggcacgugacccggggcgccguccugacccacaacgggaagcgccuggagccgaacugggccagcgugaagaaggaccucaucuccuacggcgggggcuggcggcugagcgcccaguggcagaagggggaggaggugcaggucaucgcgguggagcccggcaagaaccccaagaacuuccagacgaugcccggcaucuuccagaccaccaccggggagaucggcgccaucgcccuggacuucaagccggggacgagcggcucccccaucaucaaccgcgagggcaagguggucgggcuguacggcaacgggguggugaccaagagcggcggguacgucuccggcaucgcccagaccaacgccgagcccgacggcccgacccccgagcucgaggaggagauguucaagaagcggaaccugacgaucauggaccugcaccccgggagcggcaagacccgcaaguaccuccccgcgaucgugcgggaggccaucaagcgccggcugcgcacccugauccucgccccgacccggguggucgccgccgagauggaggaggcgcugaaggggcugcccauccgcuaccagacgaccgccaccaaguccgagcacaccggcaaggagaucguggaccucaugugccacgccacguucaccaugcggcugcugagccccgugcgcguccccaacuacaaccucaucaucauggacgaggcccacuucaccgacccggccuccaucgcggcccggggguacaucagcacccgcgugggcaugggcgaggccgccgcgaucuucaugacggccaccccccccgggaccgccgacgccuucccccaguccaacgccccgauccaggacgaggagcgggacauccccgagcgcagcuggaacuccggcaacgacuggaucaccgacuucgcggggaagacggugugguucguccccagcaucaaggccggcaacgacaucgccaacugccugcgcaagaacgggaagaaggugauccagcugucccggaagaccuucgacaccgaguaccagaagaccaagcucaacgacugggacuucguggucacgaccgacaucagcgagaugggcgccaacuucaaggccgaccgcgugaucgacccccggcgcugccugaagccggugauccugaccgacggccccgagcgggucauccucgcggggcccaugcccgugaccguggccuccgccgcccagcgccggggccgcgucgggcggaacccgcagaaggagaacgaccaguacaucuucacgggccagccccugaacaacgacgaggaccacgcccacuggaccgaggcgaagaugcugcucgacaacaucaacacccccgaggggaucauccccgcccuguucgagccggagcgcgagaagagcgccgccaucgacggcgaguaccggcugaagggcgagucccgcaagaccuucguggagcucaugcggcgcggggaccugcccguguggcuggcgcacaaggucgccagcgagggcaucaaguacaccgaccggaaguggugcuucgacggggagcgcaacaaccagauccucgaggagaacauggacguggagaucuggacgaaggagggcgagaagaagaagcugcggccccgcuggcuggacgcccggaccuacuccgacccccucgcccugaaggaguucaaggacuucgccgcgggccgcaagagcaucgccuucgaccuggucaccgagaucgggcgcgugccgagccaccucgcccaccggacccgcaacgcccuggacaaccuggugaugcuccacacguccgagcacggcgggcgggccuaccgccacgcggucgaggagcugcccgagaccauggagacccugcuccugcugggccucaugauccugcugaccgggggcgccaugcucuuccugaucagcggcaaggggaucggcaagacguccaucgggcugaucugcgugguggccagcuccggcaugcucuggauggccgacaucccccugcaguggaucgccagcgcgaucguccuggaguucuucaugauggugcuccugaucccggagcccgagaagcagcggaccccccaggacaaccagcuggccuacguggucaucgggauccucacccuggccgccaucguggccgcgaacgagaugggccugcucgagaccacgaagcgcgaccugggcauguccaaggagcccgggguggucagcccgaccuccuaccuggacguggaccuccaccccgccagcgccuggacccuguacgccguggcgaccacggucaucacccccaugcugcggcacaccaucgagaacuccaccgccaacgugagccucgccgccaucgccaaccaggcggugguccugaugggccuggacaagggguggcccaucuccaagauggaccucggcgugccgcugcuggcccucgggugcuacagccaggugaacccccugacgcugaccgccgccguccuccugcuggugacccacuacgccaucaucggccccggccuccaggcgaaggccacccgcgaggcccagaagcggacggccgccgggaucaugaagaaccccaccguggacggcaucaugaccaucgaccuggacccggucaucuacgacuccaaguucgagaagcagcuggggcaggugaugcuccuggugcugugcgcgguccagcuccugcugaugcgcaccagcugggccuucugcgaggcccucacgcuggccaccggccccaucaccacccugugggagggcucccccgggaaguucuggaacacgaccaucgcggugagcauggccaacaucuuccggggcuccuaccucgccggggccggccuggccuucagcaucaugaagagcguggggaccggcaagcgcggcaccgggucccagggcgagacgcugggggagaaguggaagaagaagcucaaccagcugagccggaaggaguucgaccuguacaagaaguccggcaucaccgaggucgaccgcaccgaggcgaaggaggggcucaagcggggcgagaucacccaccacgccgugagccgcggcuccgccaagcugcagugguucguggagcggaacauggucauccccgaggggcgcgugaucgaccugggcugcgggcggggcggguggagcuacuacugcgccggccucaagaaggugaccgagguccgcggcuacacgaaggggggcccggggcacgaggagcccgugcccauguccaccuacggcuggaacaucgugaagcugaugagcgggaaggacgucuucuaccugcccccggagaagugcgacacccuccugugcgacaucggcgaguccagccccucccccaccguggaggagagccggacgauccgcgugcugaagauggucgagcccuggcugaagaacaaccaguucugcaucaaggugcucaacccguacaugcccaccgugaucgagcaccuggagcgccugcagcggaagcacggcgggaugcucguccgcaacccccugucccggaacagcacccacgagauguacuggaucuccaacggcaccgggaacaucgugagcuccgugaacauggucagccgccugcuccugaaccgguucacgaugaccuaccgccggcccaccaucgagaaggacguggaccugggcgccggcacccgccacgugaacgcggagccggagacgcccaacauggacgucaucggggagcggauccgccggaucaaggaggagcacuccagcaccuggcacuacgacgacgagaaccccuacaagaccugggccuaccacggcagcuacgaggugaaggccaccggguccgccagcuccaugaucaacggcgucgugaagcuccugacgaagccgugggacgugguccccaccgugacccagauggccaugaccgacacgacccccuucgggcagcagcgcguguucaaggagaaggucgacacccggacccccaagccgaugcccggcacgcgcaaggugauggagaucaccgcggaguggcuguggcggacccucggccgcaacaagcggccccgccugugcacccgggaggaguucacgaagaaggugcgcaccaacgccgccaugggggccgucuucaccgaggagaaccagugggacagcgcgcgcgccgccguggaggacgaggaguucuggaagcugguggaccgggagcgcgagcuccacaagcugggcaagugcggguccugcgucuacaacaugaugggcaagcgggagaagaagcugggggaguucggcaaggccaagggcagccgcgccaucugguacauguggcucggggcgcgguaccuggaguucgaggcccugggcuuccucaacgaggaccacugguucucccgcgagaacagcuacuccgggguggagggcgaggggcugcacaagcugggcuacauccuccgggacaucagcaagauccccggcggggccauguacgccgacgacaccgccggcugggacacgcgcaucaccgaggacgaccugcacaacgaggagaagaucacccagcagauggacccggagcaccggcagcuggcgaacgccaucuucaagcucaccuaccagaacaagguggucaaggugcagcgccccacgcccaaggggaccgugauggacaucaucucccggaaggaccagcgcggcagcggccaggucgggaccuacggccugaacaccuucaccaacauggaggcccagcugauccggcagauggagggggagggcgugcucuccaagacggaccuggagaacccccaccugcucgagaagcgcaucacccaguggcuggagaccaaggggguggagcggcugaagcgcauggccaucagcggcgacgacugcgucgugaagccgaucgacgaccgguucgccaacgcgcuccuggcccugaacgacaugggcaaggugcgcaaggacaucccccaguggcagcccuccaagggguggcacgacuggcagcagguccccuucugcagccaccacuuccacgagcucaucaugaaggacggccggaagcugguggugccgugccgcccccaggacgagcugaucgggcgggcccgcaucucccagggcgccggguggagccucaaggagaccgccugccugggcaaggcguacgcccagaugugggcccugauguacuuccaccgccgggaccuccgccuggccuccaacgcgaucugcagcgccguccccgugcacugggugcccacgagccggaccaccugguccauccacgcccaccaccaguggaugaccacggaggacaugcugaccgucuggaaccgcguguggaucgaggacaacccguggauggaggacaagacccccgugaccacgugggaggacguccccuaccucggcaagcgggaggaccaguggugcgggagccugaucggccugaccucccgcgccaccugggcccagaacauccucaccgcgauccagcaggugcggagccugaucgggaacgaggaguuccuggacuacaugcccuccaugaagcgcuuccggaaggaggaggagcucgagggcgccaucugguga

SEQ ID NO: 9819 - RNA, 9873 nt, Artificial Sequence
  derived and/or modified CDS sequence (opt1) from DENV-3__AB214882__SS-prME
accagccugugccucaugaugaugcugcccgccacccuggccuuccaccucaccagccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugacguacgggaccugcaaccaggccggcgagcaccggcgcgacaagcgguccgucgcccuggcgccccacgugggcauggggcuggacacccgcacccagacguggaugagcgcggagggcgccuggcgccagguggagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggucgugcagcacgagaaccucaaguacacggugaucaucaccguccacaccggggaccagcaccaggugggcaacgagacccagggggucacggccgagaucacgccccaggccuccaccguggaggccgugcugcccgaguacggcacccuggggcucgagugcagcccccgcaccggccuggacuucaacgagaugauccugcucacgaugaagaacaaggcguggaugguccaccggcagugguucuucgaccugccgcugcccuggaccuccggcgccaccaccgagacgcccaccuggaacaagaaggagcuccuggugaccuucaagaacgcccacgccaagaagcaggagguggucgugcuggggagccaggagggcgccaugcacaccgcgcucacgggggccaccgagauccagaccuccggcgggaccagcaucuucgccggccaccugaagugccgccugaagauggacaagcucgagcugaagggcauguccuacgccaugugcagcaacgccuucgugcugaagaaggaggucagcgagacgcagcacgggaccauccucaucaagguggaguacaagggcgaggacgcgcccugcaagaucccguucuccaccgaggacgggcagggcaaggcccacaacggccggcugaucaccgccaaccccguggucacgaagaaggaggagcccgugaacaucgaggccgagcccccguucggggagagcaacaucaucaucggcaucggggacaaggcgcugaagaucaacugguacaagaagggcuccagcaucgggaagauguucgaggccaccgcccgcggcgcccggcgcauggccauccugggcgacaccgcgugggacuucggguccgugggcgggguccucaacagccugggcaagauggugcaccagaucuucggguccgccuacaccgcccuguucagcggcguguccuggaucaugaagaucggcaucgggguccuccugacguggaucggccugaacagcaagaacaccuccaugagcuucuccugcaucgugaucgggaucaucacccucuaccugggcgccgugguccaggccgacauggggugcgugaucaacuggaagggcaaggagcugaagugcggcagcgggaucuucgugaccaacgagguccacacguggaccgagcaguacaaguuccaggcggacucccccaagcggcucgccaccgccaucgccggcgccugggagaacggggugugcggcauccgcagcaccacgcgcauggagaaccugcuguggaagcagaucgcgaacgagcucaacuacauccugugggagaacaacaucaagcugaccguggucgugggggacaucaccggcauccucgagcagggcaagcggacccugacgccccagcccauggagcugaaguacuccuggaagaccugggggaaggccaagaucgugaccgccgagacccagaacagcuccuucaucaucgacggcccgaacacgcccgagugccccagcgccagccgcgcguggaacgucugggagguggaggacuacggguucggcguguucaccaccaacaucuggcucaagcugcgggagauguacacccagcugugcgaccaccgccucauguccgccgccgucaaggacgagcgggccgugcacgccgacaugggcuacuggaucgagagccagaagaacggguccuggaagcuggagaaggcgagccugaucgaggugaagaccugcacguggcccaagucccacacccucuggagcaacggcguccuggaguccgacaugaucauccccaagagccuggccgggcccaucucccagcacaacuaccgccccggcuaccacacccagaccgccgggccguggcaccucggcaagcuggagcuggacuucaacuacugcgagggcacgaccguggugaucaccgagaacugcgggacccggggccccagccuccgcacgaccaccgucuccgggaagcugauccacgaguggugcugccggagcugcacccugccgccccugcgcuacaugggcgaggacgggugcugguacggcauggagauccggccgaucaacgagaaggaggagaacauggugaagucccuggugagcgccggcuccgggaaggucgacaacuucacgaugggcgugcugugccucgccauccuguucgaggaggugaugcgcgggaaguucggcaagaagcacaugaucgcggggguccuguucaccuucgugcuccugcugagcggccagaucaccuggcgggacauggcccgcacccucaucaugaucggcuccaacgccagcgaccggauggggaugggcgugacguaccuggcccugaucgccaccuucaagauccagcccuuccucgcgcugggguucuuccugcgcaagcucaccagccgggagaaccugcugcucggcgucggccuggccauggccaccacgcugcagcuccccgaggacaucgagcagauggccaacgggaucgcgcugggccugauggcccucaagcugaucacccaguucgagaccuaccagcuguggaccgcccucgccucccugaugugcagcaacacgaucuucacccugaccguggccuggcgcaccgcgacgcucauccuggccgggaucucccugcuccccgugugccagagcuccagcaugcggaagaccgacuggcugccgaugaccgucgccgccaugggcgugccgccccucccccucuucaucuucucccugaaggacacccugaagcgccgcagcuggccgcucaacgagggggucauggccgugggccugguguccauccuggcgagcucccuccugcggaacgacguccccauggccggcccccugguggccgggggccuccugaucgccugcuacgugaucacggggaccagcgccgaccugaccgucgagaaggcggccgacgugaccugggaggaggaggccgagcagacgggcgugucccacaaccucaugaucaccgucgacgacgacgggaccaugcgcaucaaggacgacgagaccgagaacauccugaccgugcugcucaagacggcccugcugaucgugagcggcaucuuccccuacuccaucccggccacccuccuggucuggcacaccuggcagaagcagacccagcggagcggcgugcugugggacgugcccagcccgcccgagacgcagaaggcggagcucgaggagggggucuaccgcaucaagcagcagggcaucuucgggaagacccaggugggcguggggguccagaaggagggcguguuccacaccauguggcacgugacccggggcgccguccugacgcacaacgggaagcgccuggagccgaacugggccagcgugaagaaggaccucaucuccuacggcgggggcuggcggcugagcgcccaguggcagaagggggaggaggugcaggucaucgcgguggagcccggcaagaaccccaagaacuuccagaccaugcccggcaucuuccagaccaccacgggggagaucggcgccaucgcccuggacuucaagccggggaccagcggcucccccaucaucaaccgcgagggcaagguggucgggcuguacggcaacgggguggugaccaagagcggcggguacgucuccggcaucgcccagaccaacgccgagcccgacggcccgacgcccgagcucgaggaggagauguucaagaagcggaaccugaccaucauggaccugcaccccgggagcggcaagacccgcaaguaccuccccgcgaucgugcgggaggccaucaagcgccggcugcgcacccugauccucgccccgacgcggguggucgccgccgagauggaggaggcgcugaaggggcugcccauccgcuaccagaccaccgccaccaaguccgagcacacgggcaaggagaucguggaccucaugugccacgccaccuucaccaugcggcugcugagccccgugcgcguccccaacuacaaccucaucaucauggacgaggcccacuucaccgacccggccuccaucgcggcccggggguacaucagcacgcgcgugggcaugggcgaggccgccgcgaucuucaugaccgccacgccgcccgggaccgccgacgccuucccccaguccaacgccccgauccaggacgaggagcgggacauccccgagcgcagcuggaacuccggcaacgacuggaucacggacuucgcggggaagaccgugugguucguccccagcaucaaggccggcaacgacaucgccaacugccugcgcaagaacgggaagaaggugauccagcugucccggaagaccuucgacaccgaguaccagaagacgaagcucaacgacugggacuucguggucaccaccgacaucagcgagaugggcgccaacuucaaggccgaccgcgugaucgacccccggcgcugccugaagccggugauccugaccgacggccccgagcgggucauccucgcggggcccaugcccgugacgguggccuccgccgcccagcgccggggccgcgucgggcggaacccgcagaaggagaacgaccaguacaucuucaccggccagccccugaacaacgacgaggaccacgcccacuggaccgaggcgaagaugcugcucgacaacaucaacacccccgaggggaucauccccgcccuguucgagccggagcgcgagaaguccgccgccaucgacggcgaguaccggcugaagggcgagucccgcaagaccuucguggagcucaugcggcgcggggaccugcccguguggcuggcgcacaaggucgccagcgagggcaucaaguacacggaccggaaguggugcuucgacggggagcgcaacaaccagauccucgaggagaacauggacguggagaucuggaccaaggagggcgagaagaagaagcugcggccccgcuggcuggacgcccggaccuacuccgacccccucgcccugaaggaguucaaggacuucgccgcgggccgcaagagcaucgccuucgaccuggucaccgagaucgggcgcgugccgagccaccucgcccaccggacgcgcaacgcccuggacaaccuggugaugcuccacaccuccgagcacggcgggcgggccuaccgccacgcggucgaggagcugcccgagaccauggagacccugcuccugcugggccucaugauccugcugaccggcggggccaugcuguuccugaucagcgggaaggggaucggcaagaccuccaucgggcugaucugcgugguggccagcuccggcaugcucuggauggccgacaucccccugcaguggaucgccagcgcgaucguccuggaguucuucaugauggugcuccugaucccggagcccgagaagcagcggacgccccaggacaaccagcuggccuacguggucaucgggauccucacccuggccgccaucguggccgcgaacgagaugggccugcucgagacgaccaagcgcgaccugggcauguccaaggagcccgggguggucagcccgaccuccuaccuggacguggaccuccaccccgccagcgccuggacccuguacgccguggcgacgaccgucaucacccccaugcugcggcacaccaucgagaacuccacggccaacgugagccucgccgccaucgccaaccaggcggugguccugaugggccuggacaagggguggcccaucuccaagauggaccucggcgugccgcugcuggcccucgggugcuacagccaggugaacccccugacccugaccgccgccguccuccugcuggugacccacuacgccaucaucggccccggccuccaggcgaaggccacgcgcgaggcccagaagcggaccgccgccgggaucaugaagaaccccaccguggacggcaucaugaccaucgaccuggacccggucaucuacgacuccaaguucgagaagcagcugggccaggugaugcuccuggugcugugcgcgguccagcuccugcugaugcgcacgagcugggccuucugcgaggcccucacccuggccaccggccccaucaccacgcugugggagggcucccccgggaaguucuggaacaccaccaucgcggugagcauggccaacaucuuccggggcuccuaccucgccggggccggccuggccuucagcaucaugaaguccguggggaccggcaagcgcggcacggggucccagggcgagacccugggggagaaguggaagaagaagcucaaccagcugagccggaaggaguucgaccuguacaagaaguccggcaucaccgaggucgaccgcaccgaggcgaaggaggggcucaagcggggcgagaucacccaccacgccgugagccgcggcuccgccaagcugcagugguucguggagcggaacauggucauccccgaggggcgcgugaucgaccugggcugcgggcggggcggguggagcuacuacugcgccggccucaagaaggugacggagguccgcggcuacaccaagggcgggccggggcacgaggagcccgugcccauguccaccuacggcuggaacaucgugaagcugaugagcgggaaggacgucuucuaccugcccccggagaagugcgacacccuccugugcgacaucggcgaguccagccccucccccacgguggaggagagccggaccauccgcgugcugaagauggucgagcccuggcugaagaacaaccaguucugcaucaaggugcucaacccguacaugcccaccgugaucgagcaccuggagcgccugcagcggaagcacggcgggaugcucguccgcaacccccugucccggaacagcacccacgagauguacuggaucuccaacggcacggggaacaucgugagcuccgugaacauggucagccgccugcuccugaaccgguucaccaugaccuaccgccggcccaccaucgagaaggacguggaccugggcgccggcacgcgccacgugaacgcggagccggagacccccaacauggacgucaucggggagcggauccgccggaucaaggaggagcacuccagcaccuggcacuacgacgacgagaaccccuacaagaccugggccuaccacggcagcuacgaggugaaggccacgggguccgccagcuccaugaucaacggcgucgugaagcuccugaccaagccgugggacgugguccccaccgugacccagauggccaugacggacaccacccccuucgggcagcagcgcguguucaaggagaaggucgacacccggacgcccaagccgaugcccggcacccgcaaggugauggagaucaccgcggaguggcuguggcggacccucggccgcaacaagcggccccgccugugcacgcgggaggaguucaccaagaaggugcgcaccaacgccgccaugggggccgucuucaccgaggagaaccagugggacagcgcgcgcgccgccguggaggacgaggaguucuggaagcugguggaccgggagcgcgagcuccacaagcugggcaagugcggguccugcgucuacaacaugaugggcaagcgggagaagaagcugggggaguucggcaaggccaagggcagccgcgccaucugguacauguggcucggggcgcgguaccuggaguucgaggcccugggcuuccucaacgaggaccacugguucucccgcgagaacagcuacuccgggguggagggcgaggggcugcacaagcugggcuacauccuccgggacaucagcaagauccccggcggggccauguacgccgacgacacggccggcugggacacccgcaucaccgaggacgaccugcacaacgaggagaagaucacccagcagauggacccggagcaccggcagcuggcgaacgccaucuucaagcucacguaccagaacaagguggucaaggugcagcgccccacccccaaggggaccgugauggacaucaucucccggaaggaccagcgcggcagcggccaggucgggaccuacggccugaacaccuucacgaacauggaggcccagcugauccggcagauggagggggagggcgugcucuccaagaccgaccuggagaacccccaccuccucgagaagcgcaucacccaguggcuggagaccaaggggguggagcggcugaagcgcauggccaucagcggcgacgacugcgucgugaagccgaucgacgaccgguucgccaacgcgcuccuggcccugaacgacaugggcaaggugcgcaaggacaucccccaguggcagcccuccaagggguggcacgacuggcagcagguccccuucugcagccaccacuuccacgagcucaucaugaaggacggccggaagcugguggugccgugccgcccccaggacgagcugaucgggcgggcccgcaucucccagggcgccggguggagccucaaggagacggccugccugggcaaggcguacgcccagaugugggcccugauguacuuccaccgccgggaccuccgccuggccuccaacgcgaucugcagcgccguccccgugcacugggugcccaccagccggaccaccugguccauccacgcccaccaccaguggaugacgaccgaggacaugcugaccgucuggaaccgcguguggaucgaggacaacccguggauggaggacaagacccccgugacgaccugggaggacguccccuaccucggcaagcgggaggaccaguggugcgggagccugaucggccugaccucccgcgccaccugggcccagaacauccucacggcgauccagcagguccggagccugaucgggaacgaggaguuccuggacuacaugcccuccaugaagcgcuuccggaaggaggaggagagcgagggcgccaucugguga

SEQ ID NO: 9820 - RNA, 9873 nt, Artificial Sequence
  derived and/or modified CDS sequence (opt1) from DENV-3__JX669489__SS-prME
accagccugugccucaugaugauccugcccgccgcccuggcguuccaccucaccagccgggacggggagccgcggaugaucguggggaagaacgagcgcggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggugaucuucauccugcugaugcucgugacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucguccugaagaaggagguguccgagacccagcacgggaccauccucaucaagguggaguaccggggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcggcucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccggggugcuguucaccuucgugcuccugcuguccggccagaucaccuggcgcgacauggcccacacccucaucaugaucggcagcaacgccuccgaccggauggggaugggcgucacguaccuggcccugaucgcgaccuucaagauccagcccuuccucgcccugggguucuuccugcgcaagcucaccagccgggagaaccugcugcucggcgugggccuggccauggccaccacgcugcagcuccccgaggacaucgagcagaucgcgaacgggaucgcccugggccugauggcccucaagcugaucacccaguucgagaccuaccagcuguggaccgcccucaucagccugacgugcuccaacaccauguucacccugaccguggccuggcgcacggcgacccucauccuggccggggucagccugcucccggugugccaguccagcuccaugcgcaagaccgacuggcugcccauggccgucgccgccaugggcgugccgccccugccccuguucaucuucagccugaaggacacccugaagcggcgcuccuggccccucaacgagggggugauggcggucggccuggugagcauccuggccuccagccuccugcggaacgacgugcccauggccggcccccuggucgccgggggccuccugaucgccugcuacgugaucacggggaccuccgcggaccugaccguggagaaggccgccgacaucaccugggaggaggaggccgagcagacgggcgucagccacaaccucaugaucaccguggacgacgacgggaccaugcgcaucaaggacgacgagaccgagaacauccugaccgugcugcucaagacggcccugcugaucgucuccggcguguucccguacagcauccccgcgacccuccugguguggcacaccuggcagaagcagacccagcgguccggcguccugugggacgugcccagcccgcccgagacgcagaaggccgagcucgaggaggggguguaccgcaucaagcagcagggcaucuucgggaagacccaggucggcgugggggugcagaaggagggcgucuuccacaccauguggcacgugacccggggcgccgugcugacguacaacgggaagcgccuggagcccaacugggccuccgucaagaaggaccucaucagcuacggcgggggcuggcggcuguccgcgcaguggcagaagggggaggagguccaggugaucgccgucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgcggagccggacggccccacccccgagcucgaggaggagauguucaagaagcggaaccugaccaucauggaccugcaccccgggagcggcaagacccgcaaguaccucccggccaucguccgggaggccaucaagcgccggcugcgcacgcugauccucgcccccacccgggugguggccgcggagauggaggaggcccugaaggggcugcccauccgcuaccagaccaccgccacgaaguccgagcacaccggccgggagaucgucgaccucaugugccacgccaccuucaccaugcgccugcugagccccgugcgggugccgaacuacaaccucaucaucauggacgaggcccacuucacggaccccgcguccaucgccgcccgcggguacaucagcacccgcgucggcaugggcgaggccgcggccaucuucaugaccgccacgccgcccgggacggccgacgccuucccgcaguccaacgcgcccauccaggacgaggagcgggacauccccgagcgcagcuggaacuccggcaacgaguggaucaccgacuucgccgggaagaccgugugguucgugcccagcaucaaggccggcaacgacaucgccaacugccugcggaagaacgggaagaaggucauccagcugucccgcaagaccuucgacacggaguaccagaagaccaagcucaacgacugggacuucguggugaccaccgacaucagcgagaugggcgccaacuucaaggcggaccgggucaucgacccgcgccggugccugaagcccgugauccugacggacggccccgagcgcgugauccucgccgggcccaugccggucaccgccgccuccgccgcgcagcggcgcggccggguggggcgcaacccccagaaggagaacgaccaguacaucuucaccggccagccccugaacaacgacgaggaccacgcccacuggaccgaggccaagaugcugcucgacaacaucaacacccccgaggggaucaucccggcccuguucgagcccgagcgggagaaguccgcggccaucgacggcgaguaccgccugaagggcgagucccggaagacguucguggagcucaugcgccgcggggaccugcccgucuggcuggcccacaagguggccagcgagggcaucaaguacaccgaccgcaaguggugcuucgacgggcagcggaacaaccagauccucgaggagaacauggacgucgagaucuggaccaaggagggcgagaagaagaagcugcgcccccgcuggcuggacgcccggaccuacuccgacccgcucgcgcugaaggaguucaaggacuucgccgccggccgcaagagcaucgcccuggaccucgugacggagaucgggcgggugcccucccaccuggcccaccgcacccggaacgcgcuggacaaccucgucaugcugcacaccagcgagcacggcgggcgcgccuaccggcacgccguggaggagcugcccgagaccauggagacgcuccugcugcucggccugaugauccugcucaccgggggcgccaugcuguuccugaucagcggcaaggggaucggcaagaccuccaucgggcucaucugcgugaucgccagcuccggcaugcuguggauggcggagaucccgcugcaguggaucgccagcgccaucguccucgaguucuucaugauggugcugcugauccccgagcccgagaagcagcgcacgccccaggacaaccagcucgccuacguggucaucgggauccugacgcuggccgcgaucaucgccgccaacgagaugggccuccuggagaccaccaagcgggaccugggcauguccaaggagccggggguggugagccccaccuccuaccucgacgucgaccugcaccccgccagcgcguggacgcuguacgccguggccaccaccgugaucacccccaugcuccgccacacgaucgagaacuccaccgccaacgucagccuggccgcgaucgccaaccaggccguggugcugaugggccucgacaagggguggccgaucuccaagauggaccugggcgucccccugcucgcccuggggugcuacagccaggugaacccccugacccucaccgccgcggugcugcugcucaucacgcacuacgccaucaucggccccggccugcaggccaaggccacccgggaggcccagaagcgcaccgcggccgggaucaugaagaacccgaccgucgacggcaucaugacgaucgaccuggaccccgugaucuacgacuccaaguucgagaagcagcucggccaggugaugcugcugguccucugcgccgugcagcugcugcucaugcggaccagcugggcccugugcgaggcgcugacccucgccaccggccccaucacgacccugugggagggcucccccgggaaguucuggaacaccaccaucgccgugagcauggccaacaucuuccgcggcuccuaccuggccggggcgggccucgccuucagcaucaugaaguccgucgggacgggcaagcggggcaccgggagccagggcgagacccugggggagaaguggaagaagaagcugaaccagcucagccgcaaggaguucgaccuguacaagaaguccggcaucaccgagguggaccggaccgaggccaaggaggggcugaagcgcggcgagaucacgcaccacgccgugagccggggcuccgccaagcuccagugguucgucgagcgcaacauggugaucccggaggggcgggugaucgaccugggcugcgggcgcggcggguggagcuacuacugcgcgggccugaagaaggucaccgaggugcgcggcuacaccaagggcgggcccgggcacgaggagcccgugcccauguccaccuacggcuggaacaucgucaagcucaugagcgggaaggacguguucuaccugccgcccgagaagugcgacacgcugcugugcgacaucggcgaguccagccccucccccaccguggaggagagccggaccauccgcguccucaagaugguggagccguggcugaagaacaaccaguucugcaucaaggugcugaaccccuacaugcccaccgucaucgagcaccucgagcggcugcagcgcaagcacggcgggaugcuggugcggaacccccucucccgcaacagcacgcacgagauguacuggaucuccaacggcaccgggaacaucguggccagcgucaacauggugucccggcugcugcucaaccgcuucaccaugacccaccggcgcccgacgaucgagaaggacguggaccugggcgccggcacccggcacgucaacgccgagcccgagacccccaacauggacgugaucggggagcgcaucaagcggaucaaggaggagcacaacagcaccuggcacuacgacgacgagaacccguacaagacgugggccuaccacggcuccuacgaggugaaggcgaccgggagcgccuccagcaugaucaacggcgucgugaagcugcucaccaagcccugggacgucgugcccauggugacccagauggccaugacggacaccacccccuucgggcagcagcgcgucuucaaggagaagguggacacccggacgccgcgcagcaugcccggcacccggcgcgugaugggcaucaccgccgaguggcuguggcggacccuggggcgcaacaagaagccccgccucugcacgcgggaggaguucaccaagaagguccgcaccaacgcggccaugggcgccguguucaccgaggagaaccagugggacuccgccaaggccgcgguggaggacgaggacuucuggaagcuggucgaccgggagcgcgagcugcacaagcucgggaagugcggcagcugcguguacaacaugauggggaagcgggagaagaagcugggcgaguucggcaaggccaaggggucccgcgccaucugguacauguggcugggcgcccgguaccucgaguucgaggcccugggguuccugaacgaggaccacugguucagccgcgagaacuccuacagcggcguggagggggagggccuccacaagcugggcuacauccugcgggacaucuccaagauccccgggggcgcgauguacgccgacgacacggccgggugggacacccgcaucaccgaggacgaccuccacaacgaggagaagaucacccagcagauggacccggagcaccggcagcuggccaacgccaucuucaagcugacguaccagaacaaggucgugaaggugcagcgccccacccccaccggcaccgucauggacaucaucagccggaaggaccagcgcggcuccggccaggugggcaccuacgggcucaacacguucaccaacauggaggcgcagcugauccggcagauggagggcgagggggugcugagcaaggccgaccucgagaacccccaccucccggagaagaagaucacccaguggcuggagaccaagggcgucgagcgccucaagcggauggccaucuccggcgacgacugcguggugaagcccaucgacgaccgcuucgccaacgcccugcuggcgcucaacgacauggggaagguccggaaggacaucccccaguggcagcccagcaagggcuggcacgacuggcagcaggucccguucugcucccaccacuuccacgagcugaucaugaaggacgggcgcaagcuggugguccccugccggccccaggacgagcucaucggccgcgcccgcaucagccagggggccggcuggucccugcgggagacggccugccugggcaaggcguacgcccagauguggagccucauguacuuccaccgccgggaccugcgccuggccuccaacgccaucugcagcgccgugcccgugcacugggucccgaccucccggaccaccuggagcauccacgcgcaccaccaguggaugacgaccgaggacaugcucaccguguggaaccgcguguggaucgaggacaaccccuggauggaggacaagacccccgucacgaccugggagaacgugcccuaccuggggaagcgggaggaccaguggugcggcagccugaucgggcucaccucccgcgccaccugggcccagaacaucccgacggccauccagcagguccggagccugaucggcaacgaggaguuccuggacuacaugcccuccaugaagcgcuuccggaaggaggaggagagcgagggggccaucugguga

SEQ ID NO: 9821 - RNA, 9873 nt, Artificial Sequence
  derived and/or modified CDS sequence (opt1) from DENV-3__JX669498__SS-prME
accagccucugccucaugaugauccugcccgccgcccuggcguuccaccucaccucccgcgacggggagccccggaugaucguggggaagaacgagcgcggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcaccccggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugcccgaggagcaggaccagaacuacgucugcaagcacaccuacguggaccgcggguggggcaacgggugcggccucuucgggaagggcucccuggugaccugcgccaaguuccagugccuggagagcaucgagggcaaggucgugcaguacgagaaccucaaguacaccgugaucaucacgguccacaccggggaccagcaccaggugggcaacgagacccagggggucaccgccgagaucacgccccaggccuccaccaccgaggcgauccugcccgaguacggcacccuggggcucgagugcagcccccggaccggccuggacuucaacgagaugauccugcucacgaugaagaacaaggccuggauggugcaccgccagugguucuucgaccugccgcugcccuggaccuccggcgccaccaccgagacgcccaccuggaaccggaaggagcuccuggugaccuucaagaacgcccacgccaagaagcaggaggucguggugcuggggagccaggagggcgcgaugcacaccgcccucacgggggccaccgagauccagaacuccggcgggaccagcaucuucgccggccaccugaagugccgccugaagauggacaagcucgagcugaagggcauguccuacgccaugugcaccaacacguucguccugaagaaggaggugagcgagacccagcacgggaccauccucaucaagguggaguacaagggcgaggacgcgcccugcaagaucccguucagcaccgaggacgggcagggcaaggcccacaacggccggcugaucacggccaaccccgucgugaccaagaaggaggagcccgugaacaucgaggccgagcccccguucggggaguccaacaucgucaucggcaccggggacaacgcgcugaagaucaacugguacaagaagggcagcuccaucgggaagauguucgaggccaccgcccgcggcgcccggcgcauggccauccugggcgacacggcgugggacuucgggagcgugggcggggugcucaacucccugggcaagaugguccaccagaucuucgggagcgccuacaccgcccuguucuccggcgugagcugggugaugaagaucggcaucgggguccuccugaccuggaucggccugaacuccaagaacaccagcauguccuucagcugcaucgccaucgggaucaucacgcucuaccugggcgccguggugcaggcggacauggggugcgucaucaacuggaagggcaaggagcugaagugcggcuccgggaucuucgugaccaacgaggugcacaccuggaccgagcaguacaaguuccaggccgacagccccaagcgccucgccacggccaucgccggcgcgugggagaacggggucugcggcauccgguccaccacccgcauggagaaccugcuguggaagcagaucgccaacgagcucaacuacauccugugggagaacaacaucaagcugaccgugguggucggggacaucaucggcgugcucgagcagggcaagcggacgcugacgccccagcccauggagcugaaguacagcuggaagaccugggggaaggccaagaucgugaccgccgagacgcagaacuccagcuucaucaucgacggcccgaacacccccgagugccccuccgcgagccgcgccuggaacgucugggagguggaggacuacggguucggcguguucaccaccaacaucuggcucaagcugcgggaggucuacacccagcugugcgaccaccgccucaugagcgccgccgugaaggacgagcgggccgugcacgcggacaugggcuacuggaucgagucccagaagaacgggagcuggaagcuggagaaggccucccugaucgaggucaagacgugcaccuggcccaagagccacacccucugguccaacggcgugcuggagagcgacaugaucaucccgaagucccuggccgggcccaucagccagcacaaccaccgccccggcuaccacacccagacggccgggccguggcaccucggcaagcuggagcuggacuucaacuacugcgagggcaccaccguggucaucaccgagaacugcgggacgcggggccccucccuccgcaccaccaccgugagcgggaagcugauccacgaguggugcugccgguccugcacgcugccgccccuccgcuacaugggcgaggacgggugcugguacggcauggagauccggccgaucagcgagaaggaggagaacauggugaagucccuggucagcgccggcuccgggaagguggacaacuucaccaugggcgugcugugccucgcgauccuguucgaggaggucaugcgcgggaaguucggcaagaagcacaugaucgccgggguguucuucaccuucgugcugcuccugagcggccagaucaccuggcgggacauggcccacacgcugaucaugaucggcuccaacgccagcgaccgcauggggaugggcgucaccuaccucgcccugaucgcgaccuucaagauccagcccuuccuggcccucggguucuuccugcggaagcugaccagccgcgagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucucccugaccugcagcaacaccauguucacccugacgguggccuggcggaccgcgacccugauccucgccggggucucccugcugcccgugugccagagcuccagcaugcgcaagaccgacuggcucccgauggccgucgccgccaugggcgugccgccccucccccuguucaucuucucccucaaggacacgcugaagcgccggagcuggccgcugaacgagggggugauggcggucggccucguguccauccuggccagcucccugcuccgcaacgacgugcccauggccggcccccuggucgccgggggccugcucaucgccugcuacgugaucaccgggaccagcgcggaccugaccguggagaaggccgccgacaucacgugggaggaggaggccgagcagaccggcgucucccacaaccugaugaucaccguggacgacgacgggaccaugcggaucaaggacgacgagaccgagaacauccucacggugcugcugaagaccgcccuccugaucgucagcggcguguuccccuacuccaucccggcgacccugcucguguggcacaccuggcagaagcagacgcagcgcagcggcguccugugggacgugcccagcccgcccgagacccagaaggccgagcuggaggaggggguguaccggaucaagcagcagggcaucuucgggaagacccaggucggcgugggggugcagaaggagggcgucuuccacaccauguggcacgugacgcgcggcgccgugcucaccuacaacgggaagcggcuggagccgaacugggccagcgucaagaaggaccugaucuccuacggcgggggcuggcgccucagcgcgcaguggcagaagggggaggagguccaggugaucgccgucgagcccggcaagaaccccaagaacuuccagaccaugcccggcaccuuccagacgaccaccggggagaucggcgccaucgcccuggacuucaagccggggaccagcggcucccccaucaucaaccgggagggcaaggugguggggcuguacggcaacggggucgugacgaagaacggcggguacgugagcggcaucgcccagaccaacgcggagcccgacggcccgacccccgagcuggaggaggagauguucaagaagcgcaaccucaccaucauggaccugcaccccggguccggcaagacgcggaaguaccugcccgccaucguccgcgaggccaucaagcggcgccuccggacccugauccuggccccgacccgcgugguggccgcggagauggaggaggcccucaaggggcugcccauccgguaccagaccacggccaccaagagcgagcacaccggccgcgagaucgucgaccugaugugccacgccaccuucacgaugcggcuccugucccccgugcgcgugcccaacuacaaccugaucaucauggacgaggcccacuucaccgacccggcgagcaucgccgcccggggguacaucuccacccgcgucggcaugggcgaggccgcggccaucuucaugaccgccacgccgcccgggaccgccgacgccuucccccagagcaacgcgccgauccaggacgaggagcgcgacauccccgagcgguccuggaacagcggcaacgaguggaucaccgacuucgccgggaagaccgugugguucgugcccuccaucaaggccggcaacgacaucgccaacugccuccgcaagaacgggaagaaggucauccagcugagccggaagacguucgacaccgaguaccagaagaccaagcugaacgacugggacuucguggugaccacggacaucuccgagaugggcgccaacuucaaggcggaccgcgucaucgacccccggcgcugccucaagccggugauccugaccgacggccccgagcgggugauccuggccgggcccaugcccgucaccgccgccagcgccgcgcagcgccggggccgcguggggcggaacccgcagaaggagaacgaccaguacaucuucaccggccagccccucaacaacgacgaggaccacgcccacuggaccgaggccaagaugcugcuggacaacaucaacacgcccgaggggaucauccccgcccucuucgagccggagcgcgagaaguccgcggccaucgacggcgaguaccggcugaagggcgagagccgcaagaccuucguggagcugaugcggcgcggggaccuccccgucuggcuggcccacaagguggccuccgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccgcacguacagcgacccccuggcgcucaaggaguucaaggacuucgccgccggccggaaguccaucgcccuggaccuggugaccgagaucgggcgcgugccgagccaccucgcccaccggacccgcaacgcgcuggacaaccuggucaugcuccacaccagcgagcacggcgggcgggccuaccgccacgccguggaggagcugcccgagacgauggagacccugcuccugcugggccucaugauccugcugaccgggggcgccaugcuguuccugaucuccggcaaggggaucggcaagaccagcaucgggcugaucugcgugaucgccuccagcggcaugcucuggauggcggagaucccccugcaguggaucgccuccgccaucguccuggaguucuucaugauggugcuccugaucccggagcccgagaagcagcggacgccccaggacaaccagcuggccuacguggucaucgggauccucacccuggccgcgaucaucgccgccaacgagaugggccugcucgagaccaccaagcgcgaccugggcaugagcaaggagcccggggugguguccccgacgagcuaccuggacgucgaccuccaccccgccuccgcguggacccuguacgccguggccaccaccgugaucacgcccaugcugcggcacaccaucgagaacagcaccgccaacgucucccucgccgcgaucgccaaccaggccguggugcugaugggccuggacaagggguggcccaucagcaagauggaccucggcgucccgcugcuggcccucgggugcuacucccaggugaacccccugacccugacggccgcggugcuccugcugaucacccacuacgccaucaucggccccggccuccaggccaaggccacccgcgaggcccagaagcggaccgcggccgggaucaugaagaaccccacggucgacggcaucaugaccaucgaccuggacccggugaucuacgacagcaaguucgagaagcagcugggccaggugaugcuccugguccugugcgccgugcagcuccugcugaugcgcaccuccugggcccucugcgaggcgcugacccuggccacgggccccaucaccacccucugggagggcagccccgggaaguucuggaacaccacgaucgccguguccauggccaacaucuuccggggcagcuaccuggccggggcgggccuggccuucuccaucaugaaguccgucgggaccggcaagcgcggcaccgggagccagggcgagacccucggggagaaguggaagaagaagcugaaccagcugagccggaaggaguucgaccucuacaagaaguccggcaucaccgagguggaccgcacggaggccaaggaggggcugaagcggggcgagaucacccaccacgccgugucccgcggcagcgccaagcugcagugguucgucgagcggaacauggugauccccgaggggcgcgugaucgaccucggcugcgggcggggcgggugguccuacuacugcgcgggccugaagaaggucaccgaggugcgcggcuacaccaagggcgggccggggcacgaggagcccgugcccaugagcacguacggcuggaacaucgucaagcugauguccgggaaggacguguucuaccucccgcccgagaagugcgacacccugcugugcgacaucggcgagagcucccccagccccaccguggaggagucccgcaccauccggguccugaagaugguggagcccuggcucaagaacaaccaguucugcaucaaggugcugaaccccuacaugcccacggucaucgagcaccuggagcgccuccagcggaagcacggcgggaugcuggugcgcaacccccugagccggaacuccacccacgagauguacuggaucagcaacggcaccgggaacaucguggccuccgucaacauggugagccgccuccugcugaaccgguucaccaugacgcaccgccggcccaccaucgagaaggacguggaccucggcgccggcacccgccacgucaacgccgagccggagacccccaacauggacgugaucggggagcggaucaagcgcaucaaggaggagcacaacuccacguggcacuacgacgacgagaaccccuacaagaccugggccuaccacggcagcuacgaggugaaggcgaccggguccgccagcagcaugaucaacggcgucgugaagcugcugaccaagccgugggacgucgugcccauggugacgcagauggccaugaccgacaccacccccuucgggcagcagcgggucuucaaggagaagguggacacgcgcacgccccgguccaugccgggcacccgccgggugaugggcaucaccgccgaguggcucuggcgcacgcuggggcggaacaagaagccccgccugugcacccgcgaggaguucaccaagaagguccggaccaacgcggccaugggcgccguguucacggaggagaaccagugggacagcgccaaggccgcgguggaggacgaggacuucuggaagcucgucgaccgcgagcgggagcugcacaagcuggggaagugcggcuccugcguguacaacaugauggggaagcgcgagaagaagcucggcgaguucggcaaggccaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgcgauguacgccgacgacaccgccgggugggacacccggaucaccgaggacgaccugcacaacgaggagaagaucacgcagcagauggaccccgagcaccgccagcucgccaacgccaucuucaagcugaccuaccagaacaaggucgugaaggugcagcggccgacccccaccggcaccgucauggacaucaucucccgcaaggaccagcggggcagcggccaggugggcacguacgggcugaacaccuucaccaacauggaggcgcagcucauccgccagauggagggcgagggggugcuguccaaggccgaccuggagaacccccaccuccccgagaagaagaucacccaguggcuggagacgaagggcgucgagcggcugaagcgcauggccaucagcggcgacgacugcguggugaagccgaucgacgaccgguucgggaacgcccuccuggcccugaacgacaugggcaagguccgcaaggacaucccccaguggcagcccuccaagggguggcacgacuggcagcagguccccuucugcagccaccacuuccacgagcucaucaugaaggacggccggaagcugguggucccgugccgcccccaggacgagcugaucgggcgggcgcgcaucucccagggcgccggcuggagccuccgcgagaccgccugccuggggaaggccuacgcgcagauguggucccugauguacuuccaccggcgcgaccuccggcuggccagcaacgccaucugcuccgccgugcccgugcacuggguccccaccagccgcaccacguggagcauccacgcccaccaccaguggaugaccaccgaggacaugcugaccguguggaaccggguguggaucgaggacaacccguggauggaggacaagacgcccgucaccaccugggagaacgugcccuaccucggcaagcgcgaggaccaguggugcgggucccugaucggccugaccagccgggcgacgugggcccagaacauccccaccgccauccagcagguccgcucccucaucgggaacgaggaguuccuggacuacaugccgagcaugaagcgguuccgcaaggaggaggaguccgagggcgccaucugguga

SEQ ID NO: 9822 - RNA, 9873 nt, Artificial Sequence
  derived and/or modified CDS sequence (opt1) from DENV-3__KF954946__SS-prME
accagccugugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgauccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccaggggaucaccgccgagaucacgccccaggccagcacgaccgaggcgauccugcccgaguacggcacccuggggcucgagugcuccccgcgcaccggccuggacuucaacgagaugauccugcucaccaugaagaacaaggccuggaugguccaccggcagugguucuucgaccugccccugcccuggacgagcggcgccaccaccgagacccccacguggaaccgcaaggagcuccuggugaccuucaagaacgcccacgccaagaagcaggagguggucgugcuggggucccaggagggcgcgaugcacaccgcccucaccggggccacggagauccagaacagcggcgggaccuccaucuucgccggccaccugaagugccggcugaagauggacaagcucgagcugaagggcaugagcuacgccaugugcaccaacaccuucgugcugaagaaggaggucuccgagacgcagcacgggaccauccucaucaagguggaguacaagggcgaggacgcgccgugcaagauccccuucagcaccgaggacgggcagggcaaggcccacaacggccgccugaucaccgccaaccccguggucacgaagaaggaggagcccgugaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgucggcggggugcucaacagccugggcaagauggugcaccagaucuucggguccgccuacaccgcccuguucagcggcgucuccugggugaugaagaucggcaucggggugcuccugacguggaucggccugaacagcaagaacaccuccaugagcuucuccugcaucgccaucgggaucaucacccucuaccugggcgccgucgugcaggcggacauggggugcgugaucaacuggaagggcaaggagcugaagugcggcagcgggaucuucgucaccaacgaggugcacacguggaccgagcaguacaaguuccaggccgacucccccaagcgccucgccaccgccaucgugggcgccugggagaacggggucugcggcauccgcagcaccacgcggauggagaaccugcuguggaagcagaucgcgaacgagcucaacuacauccugugggagaacaacaucaagcugaccgugguggucggggacaccaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgccucccgggcguggaacgucugggagguggaggacuacggguucggcguguucaccaccaacaucuggcucaagcugcgcgaggucuacacccagaugugcgaccaccggcugaugagcgccgccgugaaggacgagcgcgccgugcacgccgacaugggcuacuggaucgagagccagaagaacggguccuggaagcucgagaaggcgagccugaucgaggucaagaccugcacguggccgaagucccacacccuguggagcaacggcgugcucgaguccgacaugaucauccccaagagccuggccgggcccaucucccagcacaacuaccggccgggcuaccacacccagaccgccgggcccuggcaccugggcaagcucgagcuggacuucaacuacugcgagggcacgaccguggucaucaccgagaacugcgggacccgcggccccagccugcggacgaccaccguguccgggaagcucauccacgaguggugcugccgcagcugcacccugcccccgcugcgguacaugggcgaggacgggugcugguacggcauggagauccgccccaucuccgagaaggaggagaacauggucaagagccucgucuccgccggcagcgggaagguggacaacuucacgaugggcgugcugugccuggccauccucuucgaggaggucaugcgggggaaguucggcaagaagcacaugaucgcggggguguucuucaccuucgugcugcugcucuccggccagaucaccuggcgcgacauggcccacacccugaucaugaucggcagcaacgccuccgaccggauggggaugggcgucacguaccuggcccucaucgccaccuucaagauccagcccuuccuggcgcugggguucuuccuccgcaagcugaccagccgggagaaccugcuccugggcgugggccuggccauggccaccacgcuccagcugcccgaggacaucgagcagauggccaacgggaucgcgcugggccucauggcccugaagcugaucacccaguucgagaccuaccagcucuggaccgcccugaucagccugacgugcuccaacaccaucuucacccucaccguggccuggcgcacggccacccugauccuggcgggggucagccuccugccggugugccaguccagcuccaugcggaagaccgacuggcugcccaugaccgucgccgccaugggcgugccgccccucccgcuguucaucuucagccugaaggacacgcucaagcgccgcuccuggccccugaacgagggggugauggccgucggccuggugagcaugcucgccuccagccugcugcggaacgacgugcccauggcgggcccccucgucgccgggggccugcugaucgccugcuacgugaucaccgggaccuccgccgaccucaccguggagaaggccgcggacgucacgugggaggaggaggccgagcagaccggcgugagccacaaccugaugaucaccguggacgacgacgggaccaugcgcaucaaggacgacgagaccgagaacauccugacgguccuccugaagaccgcccugcucaucguguccggcaucuucccguacagcauccccgccacccugcugguguggcacaccuggcagaagcagacgcagcgguccggcguccucugggacgugcccagcccgcccgagacccagaaggccgagcuggaggaggggguguaccgcaucaagcagcagggcauccuggggaagacccaggucggcgugggggugcagaaggacggcgucuuccacaccauguggcacgugacgcggggcgcggugcucacccacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucguccgggaggcgaucaagcgccggcuccgcacccugauccuggcccccacccgggugguggccgccgagauggaggaggcccucaaggggcugcccauccgcuaccagaccacggcgaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggguacaucagcacccgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcgggugcccucccaccucgcccaccgcacccggaacgcccuggacaaccuggucaugcuccacaccagcgagcacggcgggcgcgccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucaccauggccgccaucaucgccgcgaacgagaugggccugcuggagaccaccaagcgggaccucggcauguccaaggagccggggguggugagccccacguccuaccuggacgucgaccugcaccccgccagcgccuggacccucuacgccguggcgaccaccgugaucacgcccaugcugcgccacaccaucgagaacuccaccgccaacgucagccuggccgccaucgccaaccaggcgguggugcuccugggccuggacaagggguggccgaucuccaagauggaccucggcgucccccugcuggcccucgggugcuacagccaggugaacccccugacccugacggccgccgugcuccugcuggucacccacuacgccaucaucggccccggccuccaggcgaaggccacccgggaggcccagaagcgcaccgccgccgggaucaugaagaacccgacgguggacggcaucaucaccaucgaccuggaccccgugaucuacgacuccaaguucgagaagcagcuggggcaggucaugcuccuggugcugugcgcggugcagcuccugcugaugcggaccagcugggcccucugcgaggcccugacccuggccacgggccccaucaccacccucugggagggcucccccgggaaguucuggaacaccacgaucgcggucagcauggccaacaucuuccgcggcuccuaccuggccggggccggccuggccuucagcaucaugaaguccguggggaccggcaagcggggcaccgggagccagggcgagacccucggggagaaguggaagaagaagcugaaccagcugagccgcaaggaguucgaccucuacaagaaguccggcaucaccgagguggaccggacggaggcgaaggaggggcugaagcgcggcgagaccacccaccacgccgucagccggggcuccgccaagcugcagugguucguggagcgcaacauggugaucccggaggggcgggucaucgaccucggcugcgggcgcggcggguggagcuacuacugcgccggccugaagaaggugaccgaggugcggggcuacacgaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccaccgucgaggagagccgcacgauccgcgugcugaagaugguggagccguggcucaagaacaaccaguucugcaucaagguccugaaccccuacaugcccgccgugaucgagcaccuggagcggcuccagcgcaagcacggcgggaugcuggugcggaacccccugucccgcaacagcacccacgagauguacuggaucuccaacggcaccgggaacaucgucagcuccgugaacauggugagccggcuccugcugaaccgcuucaccaugacgcaccggcgcccgaccaucgagaaggacgucgaccucggcgcgggcacccggcacgugaacgccgagcccgagacccccaacauggacgugaucggggagcgcaucaagcggaucaaggaggagcacaacuccacguggcacuacgacgacgagaacccguacaagaccugggccuaccacggcagcuacgaggucaaggccaccggguccgccagcagcaugaucaacggcguggucaagcugcugaccaagcccugggacguggugcccauggucacgcagauggcgaugaccgacaccacccccuucgggcagcagcgcguguucaaggagaagguggacacgcggaccccgcgccccaugcccggcacccggaaggucauggagaucaccgccgaguggcucuggcgcacgcugggccggaacaagcgcccccggcugugcacccgcgaggaguucaccaagaaggugcgcaccaacgccgccaugggggcgguguucacggaggagaaccagugggacuccgccaaggccgccgucgaggacgaggaguucuggaagcucguggaccgggagcgcgagcugcacaagcugggcaagugcgggagcugcguguacaacaugaugggcaagcgggagaagaagcucggggaguucggcaaggccaagggcucccgcgcgaucugguacauguggcugggggcccgguaccuggaguucgaggcccucggcuuccugaacgaggaccacugguucagccgcgagaacuccuacagcggggucgagggcgaggggcugcacaagcucggcuacauccugcgggacaucuccaagaucccgggcggggccauguacgccgacgacaccgcgggcugggacacccgcaucaccgaggacgaccugcacaacgaggagaagaucacgcagcagauggaccccgagcaccggcuccuggccaacgccaucuucaagcugaccuaccagaacaagguggugaagguccagcgccccacccccaccgggaccgugauggacaucaucagccggaaggaccagcgcggcuccggccagguggggacguacggccucaacaccuucaccaacauggaggcccagcugguccggcagauggagggggagggcgugcugagcaagaccgaccucgagaacccgcaccuccccgagaagaagaucacgcaguggcuggagaccaaggggguggagcgccucaagcggauggccaucuccggcgacgacugcgucgugaagcccaucgacgaccgcuucgcgaacgcccugcuggcccucaacgacaugggcaaggugcggaaggacaucccccaguggcagccgagcaagggguggcacgacuggcagcagguccccuucugcucccaccacuuccacgagcugaucaugaaggacggccgcaagcugguggugcccugccggccccaggacgagcucaucgggcgcgcccggaucagccagggcgccggguggucccugcgcgagaccgcgugccugggcaaggccuacgcccagauguggagccucauguacuuccaccgccgggaccugcgccuggccuccaacgcgaucugcagcgccaucccgguccacugggugcccaccucccggacgaccuggagcauccacgcccaccaccaguggaugaccaccgaggacaugcucacgguguggaaccgcgucuggaucgaggacaaccccuggauggaggacaagacccccaucaccaccugggagaacgugccguaccugggcaagcgggaggaccaguggugcgggagccugaucggccucacgucccgcgccaccugggcccagaacauccccaccgcgauccagcagguccggagccugaucgggaacgaggaguuccuggacuacaugcccuccaugaagcgcuuccggaaggaggaggagagcgagggcgccaucugguga

SEQ ID NO: 9823 - RNA, 9873 nt, Artificial Sequence
  derived and/or modified CDS sequence (opt1) from DENV-3__KF954947__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccaggggaucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgccaagaagcaggagguggucgugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggaggucuccgagacccagcacgggaccauccucaucaagguggaguacaagggcgaggacgcgccgugcaagauccccuucagcaccgaggacgggcagggcaaggcccacaacggccgccugaucacggccaaccccguggucaccaagaaggaggagcccgugaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgucggcggggugcucaacagccugggcaagauggugcaccagaucuucggguccgccuacacggcccuguucagcggcgucuccugggugaugaagaucggcaucggggugcuccugaccuggaucggccugaacagcaagaacaccuccaugagcuucuccugcaucgccaucgggaucaucacccucuaccugggcgccgucgugcaggcggacauggggugcgugaucaacuggaagggcaaggagcugaagugcggcagcgggaucuucgucacgaacgaggugcacaccuggaccgagcaguacaaguuccaggccgacucccccaagcgccucgccaccgccaucgugggcgccugggagaacggggucugcggcauccgcagcacgacccggauggagaaccugcuguggaagcagaucgcgaacgagcucaacuacauccugugggagaacaacaucaagcugaccgugguggucggggacaccaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgccucccgggcguggaacgucugggagguggaggacuacggguucggcguguucaccaccaacaucuggcucaagcugcgcgaggucuacacccagaugugcgaccaccggcugaugagcgccgccgugaaggacgagcgcgccgugcacgccgacaugggcuacuggaucgagagccagaagaacggguccuggaagcucgagaaggcgagccugaucgaggucaagacgugcaccuggccgaagucccacacccuguggagcaacggcgugcucgaguccgacaugaucauccccaagagccuggccgggcccaucucccagcacaacuaccggccgggcuaccacacccagacggccgggcccuggcaccugggcaagcucgagcuggacuucaacuacugcgagggcaccaccguggucaucaccgagaacugcgggacgcgcggccccagccugcggaccaccaccguguccgggaagcucauccacgaguggugcugccgcagcugcacgcugcccccgcugcgguacaugggcgaggacgggugcugguacggcauggagauccgccccaucuccgagaaggaggagaacauggucaagagccucgucuccgccggcagcgggaagguggacaacuucaccaugggcgugcugugccuggccauccucuucgaggaggucaugcgggggaaguucggcaagaagcacaugaucgcggggguguucuucaccuucgugcugcugcucuccggccagaucaccuggcgcgacauggcccacacgcugaucaugaucggcagcaacgccuccgaccggauggggaugggcgucaccuaccuggcccucaucgccaccuucaagauccagcccuuccuggcgcugggguucuuccuccgcaagcugaccagccgggagaaccugcuccugggcgugggccuggccauggccacgacccuccagcugcccgaggacaucgagcagauggccaacgggaucgcgcugggccucauggcccugaagcugaucacccaguucgagaccuaccagcucuggacggcccugaucagccugaccugcuccaacaccaucuucacccucacgguggccuggcgcaccgccacccugauccuggcgggggucagccuccugccggugugccaguccagcuccaugcggaagaccgacuggcugcccaugacggucgccgccaugggcgugccgccccucccgcuguucaucuucagccugaaggacacccucaagcgccgcuccuggccccugaacgagggggugauggccgucggccuggugagcaugcucgccuccagccugcugcggaacgacgugcccauggcgggcccccucgucgccgggggccugcugaucgccugcuacgugaucaccgggaccuccgccgaccucacgguggagaaggccgcggacgucaccugggaggaggaggccgagcagaccggcgugagccacaaccugaugaucaccguggacgacgacgggaccaugcgcaucaaggacgacgagacggagaacauccugaccguccuccugaagaccgcccugcucaucguguccggcaucuucccguacagcauccccgccacccugcugguguggcacacguggcagaagcagacccagcgguccggcguccucugggacgugcccagcccgcccgagacccagaaggccgagcuggaggaggggguguaccgcaucaagcagcagggcauccuggggaagacccaggucggcgugggggugcagaaggacggcgucuuccacacgauguggcacgugacccggggcgcggugcucacccacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcacguuccagaccaccaccggggagaucggcgcgaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggccaucguccgggaggcgaucaagcgccggcuccgcacccugauccuggcccccacccgggugguggccgccgagauggaggaggcccucaaggggcugcccauccgcuaccagacgaccgcgaccaaguccgagcacaccggccgggagaucgucgaccugaugugccacgccacguucaccaugcgccuccugagccccgugcgggugccgaacuacaaccugaucaucauggacgaggcccacuucaccgaccccgccuccaucgccgcgcgcggguacaucagcacccgggucggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggugugguucgugcccagcaucaaggcgggcaacgacaucgccaacugccuccggaagaacgggaagaaggucauccagcugucccgcaagaccuucgacaccgaguaccagaagaccaagcugaacgacugggacuucguggugacgaccgacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggacgaaggagggcgagaagaagaagcuccgcccccgguggcuggacgcccgcaccuacuccgacccgcuggcccucaaggaguucaaggacuucgccgcgggccgcaagagcaucgcccuggaccuggugaccgagaucgggcgggugcccucccaccucgcccaccgcacccggaacgcccuggacaaccuggucaugcuccacacgagcgagcacggcgggcgcgccuaccggcacgcgguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucaccauggccgccaucaucgccgcgaacgagaugggccugcuggagaccacgaagcgggaccucggcauguccaaggagccggggguggugagccccaccuccuaccuggacgucgaccugcaccccgccagcgccuggacccucuacgccguggcgaccacggugaucacccccaugcugcgccacaccaucgagaacuccaccgccaacgucagccuggccgccaucgccaaccaggcgguggugcucaugggccuggacaagggguggccgaucuccaagauggaccugggcgucccccuccuggcccuggggugcuacagccaggugaacccccucacgcugaccgccgccgugcugcuccuggucacccacuacgccaucaucggccccggccugcaggcgaaggccacccgggaggcccagaagcgcacggccgccgggaucaugaagaacccgaccguggacggcaucaucaccaucgaccucgaccccgugaucuacgacuccaaguucgagaagcagcuggggcaggucaugcugcucgugcugugcgcggugcagcugcuccugaugcggaccagcugggcccugugcgaggcccucacgcuggccaccggccccaucaccacccugugggagggcucccccgggaaguucuggaacacgaccaucgcggucagcauggccaacaucuuccgcggcuccuaccucgccggggccggccuggccuucagcaucaugaaguccguggggaccggcaagcggggcaccgggagccagggcgagacccugggggagaaguggaagaagaagcucaaccagcugagccgcaaggaguucgaccuguacaagaaguccggcaucacggagguggaccggaccgaggcgaaggaggggcucaagcgcggcgagaccacccaccacgccgucagccggggcuccgccaagcugcagugguucguggagcgcaacauggugaucccggaggggcgggucaucgaccugggcugcgggcgcggcggguggagcuacuacugcgccggccucaagaaggugacggaggugcggggcuacaccaagggcgggcccgggcacgaggagcccguccccauguccaccuacggcuggaacaucgugaagcugaugagcgggaaggacguguucuaccugccgcccgagaagugcgacacccuccugugcgacaucggcgaguccagccccucccccacggucgaggagagccgcaccauccgcgugcugaagaugguggagccguggcugaagaacaaccaguucugcaucaagguccucaaccccuacaugcccgccgugaucgagcaccuggagcggcugcagcgcaagcacggcgggaugcucgugcggaacccccugucccgcaacagcacccacgagauguacuggaucuccaacggcaccgggaacaucgucagcuccgugaacauggugagccggcugcuccugaaccgcuucacgaugacccaccggcgcccgaccaucgagaaggacgucgaccugggcgcgggcacccggcacgugaacgccgagcccgagacgcccaacauggacgugaucggggagcgcaucaagcggaucaaggaggagcacaacuccaccuggcacuacgacgacgagaacccguacaagaccugggccuaccacggcagcuacgaggucaaggccaccggguccgccagcagcaugaucaacggcguggucaagcuccugacgaagcccugggacguggugcccauggucacccagauggcgaugaccgacaccacgcccuucgggcagcagcgcguguucaaggagaagguggacacccggaccccgcgccccaugcccggcacccggaaggucauggagaucacggccgaguggcuguggcgcacccucggccggaacaagcgcccccggcugugcacccgcgaggaguucaccaagaaggugcgcacgaacgccgccaugggggcgguguucaccgaggagaaccagugggacuccgccaaggccgccgucgaggacgaggaguucuggaagcugguggaccgggagcgcgagcuccacaagcugggcaagugcgggagcugcguguacaacaugaugggcaagcgggagaagaagcugggggaguucggcaaggccaagggcucccgcgcgaucugguacauguggcucggggcccgguaccuggaguucgaggcccugggcuuccucaacgaggaccacugguucagccgcgagaacuccuacagcggggucgagggcgaggggcugcacaagcugggcuacauccuccgggacaucuccaagaucccgggcggggccauguacgccgacgacaccgcgggcugggacacccgcaucacggaggacgaccugcacaacgaggagaagaucacccagcggauggaccccgagcaccgccugcucgccaacgccaucuucaagcugaccuaccagaacaagguggugaagguccagcggcccacccccaccgggacggugauggacaucaucagccgcaaggaccagcggggcuccggccagguggggaccuacggccugaacaccuucaccaacauggaggcccagcucguccgccagauggagggggagggcgugcugagcaagacggaccuggagaacccgcaccuccccgagaagaagaucacccaguggcuggagaccaaggggguggagcggcugaagcgcauggccaucuccggcgacgacugcgucgugaagcccaucgacgaccgguucgcgaacgcccuccuggcccugaacgacaugggcaaggugcgcaaggacaucccccaguggcagccgagcaagggguggcacgacuggcagcagguccccuucugcucccaccacuuccacgagcucaucaugaaggacggccggaagcugguggugcccugccgcccccaggacgagcugaucgggcgggcccgcaucagccagggcgccggguggucccuccgcgagaccgcgugccugggcaaggccuacgcccagauguggagccugauguacuuccaccggcgcgaccuccggcuggccuccaacgcgaucugcagcgccaucccgguccacugggugcccacgucccgcaccaccuggagcauccacgcccaccaccaguggaugaccacggaggacaugcugaccguguggaaccgggucuggaucgaggacaaccccuggauggaggacaagacccccaucaccacgugggagaacgugccguaccucggcaagcgcgaggaccaguggugcgggagccugaucggccugaccucccgggccaccugggcccagaacauccccaccgcgauccagcagguccgcagccucaucgggaacgaggaguuccuggacuacaugcccuccaugaagcgguuccgcaaggaggaggagagcgagggcgccaucugguga

SEQ ID NO: 9824 - RNA, 9873 nt, Artificial Sequence
  derived and/or modified CDS sequence (opt1) from DENV-3__KF954945__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgauccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccaggggaucaccgccgagaucacgccccaggccagcacgaccgaggcgauccugcccgaguacggcacccuggggcucgagugcuccccgcgcaccggccuggacuucaacgagaugauccugcucaccaugaagaacaaggccuggaugguccaccggcagugguucuucgaccugccccugcccuggacgagcggcgccaccaccgagacccccacguggaaccgcaaggagcuccuggugaccuucaagaacgcccacgccaagaagcaggagguggucgugcuggggucccaggagggcgcgaugcacaccgcccucaccggggccacggagauccagaacagcggcgggaccuccaucuucgccggccaccugaagugccggcugaagauggacaagcucgagcugaagggcaugagcuacgccaugugcaccaacaccuucgugcugaagaaggaggucuccgagacgcagcacgggaccauccucaucaagguggaguacaagggcgaggacgcgccgugcaagauccccuucagcaccgaggacgggcagggcaaggcccacaacggccgccugaucaccgccaaccccguggucacgaagaaggaggagcccgugaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgucggcggggugcucaacagccugggcaagauggugcaccagaucuucggguccgccuacaccgcccuguucagcggcgucuccugggugaugaagaucggcaucggggugcuccugacguggaucggccugaacagcaagaacaccuccaugagcuucuccugcaucgccaucgggaucaucacccucuaccugggcgccgucgugcaggcggacauggggugcgugaucaacuggaagggcaaggagcugaagugcggcagcgggaucuucgucaccaacgaggugcacacguggaccgagcaguacaaguuccaggccgacucccccaagcgccucgccaccgccaucgugggcgccugggagaacggggucugcggcauccgcagcaccacgcggauggagaaccugcuguggaagcagaucgcgaacgagcucaacuacauccugugggagaacaacaucaagcugaccgugguggucggggacaccaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgccucccgggcguggaacgucugggagguggaggacuacggguucggcguguucaccaccaacaucuggcucaagcugcgcgaggucuacacccagaugugcgaccaccggcugaugagcgccgccgugaaggacgagcgcgccgugcacgccgacaugggcuacuggaucgagagccagaagaacggguccuggaagcucgagaaggcgagccugaucgaggucaagaccugcacguggccgaagucccacacccuguggagcaacggcgugcucgaguccgacaugaucauccccaagagccuggccgggcccaucucccagcacaacuaccggccgggcuaccacacccagaccgccgggcccuggcaccugggcaagcucgagcuggacuucaacuacugcgagggcacgaccguggucaucaccgagaacugcgggacccgcggccccagccugcggacgaccaccguguccgggaagcucauccacgaguggugcugccgcagcugcacccugcccccgcugcgguacaugggcgaggacgggugcugguacggcauggagauccgccccaucuccgagaaggaggagaacauggucaagagccucgucuccgccggcagcgggaagguggacaacuucacgaugggcgugcugugccuggccauccucuucgaggaggucaugcgggggaaguucggcaagaagcacaugaucgcggggguguucuucaccuucgugcugcugcucuccggccagaucaccuggcgcgacauggcccacacccugaucaugaucggcagcaacgccuccgaccggauggggaugggcgucacguaccuggcccucaucgccaccuucaagauccagcccuuccuggcgcugggguucuuccuccgcaagcugaccagccgggagaaccugcuccugggcgugggccuggccauggccaccacgcuccagcugcccgaggacaucgagcagauggccaacgggaucgcgcugggccucauggcccugaagcugaucacccaguucgagaccuaccagcucuggaccgcccugaucagccugacgugcuccaacaccaucuucacccucaccguggccuggcgcacggccacccugauccuggcgggggucagccuccugccggugugccaguccagcuccaugcggaagaccgacuggcugcccaugaccgucgccgccaugggcgugccgccccucccgcuguucaucuucagccugaaggacacgcucaagcgccgcuccuggccccugaacgagggggugauggccgucggccuggugagcaugcucgccuccagccugcugcggaacgacgugcccauggcgggcccccucgucgccgggggccugcugaucgccugcuacgugaucaccgggaccuccgccgaccucaccguggagaaggccgcggacgucacgugggaggaggaggccgagcagaccggcgugagccacaaccugaugaucaccguggacgacgacgggaccaugcgcaucaaggacgacgagaccgagaacauccugacgguccuccugaagaccgcccugcucaucguguccggcaucuucccguacagcauccccgccacccugcugguguggcacaccuggcagaagcagacgcagcgguccggcguccucugggacgugcccagcccgcccgagacccagaaggccgagcuggaggaggggguguaccgcaucaagcagcagggcauccuggggaagacccaggucggcgugggggugcagaaggacggcgucuuccacaccauguggcacgugacgcggggcgcggugcucacccacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucguccgggaggcgaucaagcgccggcuccgcacccugauccuggcccccacccgggugguggccgccgagauggaggaggcccucaaggggcugcccauccgcuaccagaccacggcgaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggguacaucagcacccgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcgggugcccucccaccucgcccaccgcacccggaacgcccuggacaaccuggucaugcuccacaccagcgagcacggcgggcgcgccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucaccauggccgccaucaucgccgcgaacgagaugggccugcuggagaccaccaagcgggaccucggcauguccaaggagccggggguggugagccccacguccuaccuggacgucgaccugcaccccgccagcgccuggacccucuacgccguggcgaccaccgugaucacgcccaugcugcgccacaccaucgagaacuccaccgccaacgucagccuggccgccaucgccaaccaggcgguggugcucaugggccuggacaagggguggccgaucuccaagauggaccugggcgucccccuccuggcccuggggugcuacagccaggugaacccccucacccugacggccgccgugcugcuccuggucacccacuacgccaucaucggccccggccugcaggcgaaggccacccgggaggcccagaagcgcaccgccgccgggaucaugaagaacccgacgguggacggcaucaucaccaucgaccucgaccccgugaucuacgacuccaaguucgagaagcagcuggggcaggucaugcugcucgugcugugcgcggugcagcugcuccugaugcggaccagcugggcccugugcgaggcccucacccuggccacgggccccaucaccacccugugggagggcucccccgggaaguucuggaacaccacgaucgcggucagcauggccaacaucuuccgcggcuccuaccucgccggggccggccuggccuucagcaucaugaaguccguggggaccggcaagcggggcaccgggagccagggcgagacccugggggagaaguggaagaagaagcucaaccagcugagccgcaaggaguucgaccuguacaagaaguccggcaucaccgagguggaccggacggaggcgaaggaggggcucaagcgcggcgagaccacccaccacgccgucagccggggcuccgccaagcugcagugguucguggagcgcaacauggugaucccggaggggcgggucaucgaccugggcugcgggcgcggcggguggagcuacuacugcgccggccucaagaaggugaccgaggugcggggcuacacgaagggcgggcccgggcacgaggagcccguccccauguccaccuacggcuggaacaucgugaagcugaugagcgggaaggacguguucuaccugccgcccgagaagugcgacacccuccugugcgacaucggcgaguccagccccucccccaccgucgaggagagccgcacgauccgcgugcugaagaugguggagccguggcugaagaacaaccaguucugcaucaagguccucaaccccuacaugcccgccgugaucgagcaccuggagcggcugcagcgcaagcacggcgggaugcucgugcggaacccccugucccgcaacagcacccacgagauguacuggaucuccaacggcaccgggaacaucgucagcuccgugaacauggugagccggcugcuccugaaccgcuucaccaugacgcaccggcgcccgaccaucgagaaggacgucgaccugggcgcgggcacccggcacgugaacgccgagcccgagacccccaacauggacgugaucggggagcgcaucaagcggaucaaggaggagcacaacuccacguggcacuacgacgacgagaacccguacaagaccugggccuaccacggcagcuacgaggucaaggccaccggguccgccagcagcaugaucaacggcguggucaagcuccugaccaagcccugggacguggugcccauggucacgcagauggcgaugaccgacaccacccccuucgggcagcagcgcguguucaaggagaagguggacacgcggaccccgcgccccaugcccggcacccggaaggucauggagaucaccgccgaguggcuguggcgcacgcucggccggaacaagcgcccccggcugugcacccgcgaggaguucaccaagaaggugcgcaccaacgccgccaugggggcgguguucacggaggagaaccagugggacuccgccaaggccgccgucgaggacgaggaguucuggaagcugguggaccgggagcgcgagcuccacaagcugggcaagugcgggagcugcguguacaacaugaugggcaagcgggagaagaagcugggggaguucggcaaggccaagggcucccgcgcgaucugguacauguggcucggggcccgguaccuggaguucgaggcccugggcuuccucaacgaggaccacugguucagccgcgagaacuccuacagcggggucgagggcgaggggcugcacaagcugggcuacauccuccgggacaucuccaagaucccgggcggggccauguacgccgacgacaccgcgggcugggacacccgcaucaccgaggacgaccugcacaacgaggagaagaucacgcagcagauggaccccgagcaccggcugcucgccaacgccaucuucaagcugaccuaccagaacaagguggugaagguccagcgccccacccccaccgggaccgugauggacaucaucagccggaaggaccagcgcggcuccggccagguggggacguacggccugaacaccuucaccaacauggaggcccagcucguccggcagauggagggggagggcgugcugagcaagaccgaccuggagaacccgcaccuccccgagaagaagaucacgcaguggcuggagaccaaggggguggagcgccugaagcggauggccaucuccggcgacgacugcgucgugaagcccaucgacgaccgcuucgcgaacgcccuccuggcccugaacgacaugggcaaggugcggaaggacaucccccaguggcagccgagcaagggguggcacgacuggcagcagguccccuucugcucccaccacuuccacgagcucaucaugaaggacggccgcaagcugguggugcccugccggccccaggacgagcugaucgggcgcgcccggaucagccagggcgccggguggucccuccgcgagaccgcgugccugggcaaggccuacgcccagauguggagccugauguacuuccaccgccgggaccuccgccuggccuccaacgcgaucugcagcgccaucccgguccacugggugcccaccucccggacgaccuggagcauccacgcccaccaccaguggaugaccaccgaggacaugcugacgguguggaaccgcgucuggaucgaggacaaccccuggauggaggacaagacccccaucaccaccugggagaacgugccguaccucggcaagcgggaggaccaguggugcgggagccugaucggccugacgucccgcgccaccugggcccagaacauccccaccgcgauccagcagguccggagccucaucgggaacgaggaguuccuggacuacaugcccuccaugaagcgcuuccggaaggaggaggagagcgagggcgccaucugguga

SEQ ID NO: 9825 - RNA, 9873 nt, Artificial Sequence
  derived and/or modified CDS sequence (opt1) from DENV-3__JX669495__SS-prME
accagccugugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccggcugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccgcggcgcccggcgcauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccggagcacgacccgcauggagaaccugcuguggaagcagaucgccaacgagcucaacuacauccugugggagaacaacaucaagcugaccgugguggucggggacaucaucggcgugcucgagcagggcaagcggacccugacgccccagccgauggagcugaaguacuccuggaagaccugggggaaggccaagaucgugaccgccgagacccagaacagcuccuucaucaucgacggccccaacacgcccgagugccccagcgcgucccgcgccuggaacgucugggagguggaggacuacggguucggcguguucaccaccaacaucuggcucaagcugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccgcccgggcuaccacacccagaccgccgggcccuggcaccucggcaagcuggagcuggacuucaacuacugcgagggcacgaccguggucaucaccgagaacugcgggacccggggccccagccuccgcacgaccaccguguccgggaagcugauccacgaguggugcugccggagcugcacccugcccccgcuccgcuacaugggcgaggacgggugcugguacggcauggagauccggcccaucuccgagaaggaggagaacauggucaagagccuggucuccgccggcagcgggaagguggacaacuucacgaugggcgugcugugccucgcgauccuguucgaggaggucaugcgcgggaaguucggcaagaagcacaugaucgccgggguguucuucaccuucgugcugcuccuguccggccagaucaccuggcgggacauggcccacacccugaucaugaucggcagcaacgccuccgaccgcauggggaugggcgucacguaccucgcccugaucgcgaccuucaagauccagcccuuccuggcccucggguucuuccugcggaagcugaccagccgcgagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccauguucacccugaccguggccuggcggacggcgacccugauccucgccggggucagccugcugccggugugccaguccagcuccaugcgcaagaccgacuggcuccccauggccgucgccgccaugggcgugccgccccucccgcuguucaucuucagccucaaggacacccugaagcgccgguccuggccccugaacgagggggugauggcggucggccucgugagcauccuggccuccagccugcuccgcaacgacgugcccauggccggcccccuggucgccgggggccugcucaucgccugcuacgugaucacggggaccuccgcggaccugaccguggagaaggccgccgacaucaccugggaggaggaggccgagcagacgggcgucagccacaaccugaugaucaccguggacgacgacgggaccaugcggaucaaggacgacgagaccgagaacauccucaccgugcugcugaagacggcccuccugaucgucuccggcguguucccguacagcauccccgcgacccugcucguguggcacaccuggcagaagcagacccagcgcuccggcguccugugggacgugcccagcccgcccgagacgcagaaggccgagcuggaggaggggguguaccggaucaagcagcagggcaucuucgggaagacccaggucggcgugggggugcagaaggagggcgucuuccacaccauguggcacgugacccgcggcgccgugcucacguacaacgggaagcggcuggagcccaacugggccuccgucaagaaggaccugaucagcuacggcgggggcuggcgccucuccgcgcaguggcagaagggggaggagguccaggugaucgccgucgagcccggcaagaaccccaagaacuuccagaccaugcccggcaccuuccagaccacgaccggggagaucggcgccaucgcccuggacuucaagcccgggaccagcggcagccccaucaucaaccgggagggcaaggugguggggcuguacggcaacggggucgugaccaagaacggcggguacguguccggcaucgcccagacgaacgcggagccggacggccccacccccgagcuggaggaggagauguucaagaagcgcaaccucaccaucauggaccugcaccccgggagcggcaagacccggaaguaccugccggccaucguccgcgaggccaucaagcggcgccuccggacgcugauccuggcccccacccgcgugguggccgcggagauggaggaggcccucaaggggcugcccauccgguaccagaccaccgccacgaaguccgagcacaccggccgcgagaucgucgaccugaugugccacgccaccuucaccaugcggcuccugagccccgugcgcgugccgaacuacaaccugaucaucauggacgaggcccacuucacggaccccgcguccaucgccgcccggggguacaucagcacccgcgucggcaugggcgaggccgcggccaucuucaugaccgccacgccgcccgggacggccgacgccuucccgcaguccaacgcgcccauccaggacgaggagcgcgacauccccgagcggagcuggaacuccggcaacgaguggaucaccgacuucgccgggaagaccgugugguucgugcccagcaucaaggccggcaacgacaucgccaacugccuccgcaagaacgggaagaaggucauccagcugucccggaagaccuucgacacggaguaccagaagaccaagcugaacgacugggacuucguggugaccaccgacaucagcgagaugggcgccaacuucaaggcggaccgcgucaucgacccgcggcgcugccucaagcccgugauccugacggacggccccgagcgggugauccuggccgggcccaugccggucaccgccgccuccgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagucccgcaagacguucguggagcugaugcggcgcggggaccuccccgucuggcuggcccacaagguggccagcgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccgcaccuacuccgacccgcuggcgcucaaggaguucaaggacuucgccgccggccgcaagagcaucgcccuggaccuggugacggagaucgggcgcgugcccucccaccucgcccaccggacccgcaacgcgcuggacaaccuggucaugcuccacaccagcgagcacggcgggcgggccuaccgccacgccguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucguccuggaguucuucaugauggugcuccugauccccgagcccgagaagcagcggacgccccaggacaaccagcuggccuacguggucaucgggauccucacgcuggccgcgaucaucgccgccaacgagaugggccugcucgagaccaccaagcgcgaccugggcauguccaaggagccggggguggugagccccaccuccuaccuggacgucgaccuccaccccgccagcgcguggacgcuguacgccguggccaccaccgugaucacccccaugcugcggcacacgaucgagaacuccaccgccaacgucagccucgccgcgaucgccaaccaggccguggugcugaugggccuggacaagggguggccgaucuccaagauggaccucggcgucccccugcuggcccucgggugcuacagccaggugaacccccugacccugaccgccgcggugcuccugcugaucacgcacuacgccaucaucggccccggccuccaggccaaggccacccgcgaggcccagaagcggaccgcggccgggaucaugaagaacccgaccgucgacggcaucaugacgaucgaccuggaccccgugaucuacgacuccaaguucgagaagcagcugggccaggugaugcuccugguccugugcgccgugcagcuccugcugaugcgcaccagcugggcccucugcgaggcgcugacccuggccaccggccccaucacgacccucugggagggcucccccgggaaguucuggaacaccaccaucgccgugagcauggccaacaucuuccggggcuccuaccuggccggggcgggccuggccuucagcaucaugaaguccgucgggacgggcaagcgcggcaccgggagccagggcgagacccucggggagaaguggaagaagaagcugaaccagcugagccggaaggaguucgaccucuacaagaaguccggcaucaccgagguggaccgcaccgaggccaaggaggggcugaagcggggcgagaucacgcaccacgccgugagccgcggcuccgccaagcugcagugguucgucgagcggaacauggugaucccggaggggcgcgugaucgaccucggcugcgggcggggcggguggagcuacuacugcgcgggccugaagaaggucaccgaggugcgcggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccggguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacgcacgagauguacuggaucuccaacggcaccgggaacaucguggccagcgucaacauggugucccgccuccugcugaaccgguucaccaugacccaccgccggccgacgaucgagaaggacguggaccucggcgccggcacccgccacgucaacgccgagcccgagacccccaacauggacgugaucggggagcggaucaagcgcaucaaggaggagcacaacagcaccuggcacuacgacgacgagaacccguacaagacgugggccuaccacggcuccuacgaggugaaggcgaccgggagcgccuccagcaugaucaacggcgucgugaagcugcugaccaagcccugggacgucgugcccauggugacccagauggccaugacggacaccacccccuucgggcagcagcgggucuucaaggagaagguggacacccgcacgccgcggagcaugcccggcacccgccgggugaugggcaucaccgccgaguggcucuggcgcacccuggggcggaacaagaagccccgccugugcacgcgcgaggaguucaccaagaagguccggaccaacgcggccaugggcgccguguucaccgaggagaaccagugggacuccgccaaggccgcgguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgcgauguacgccgacgacacggccgggugggacacccggaucaccgaggacgaccugcacaacgaggagaagaucacccagcagauggacccggagcaccgccagcucgccaacgccaucuucaagcugacguaccagaacaaggucgugaaggugcagcggcccacccccaccggcaccgucauggacaucaucagccgcaaggaccagcggggcuccggccaggugggcaccuacgggcugaacacguucaccaacauggaggcgcagcucauccgccagauggagggcgagggggugcugagcaaggccgaccuggagaacccccaccucccggagaagaaggucacccaguggcuggagaccaagggcguggagcggcugaagcgcauggccaucuccggcgacgacugcguggucaagcccaucgacgaccgguucgccaacgcccuccuggcgcugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggccggcuggucccuccgcgagacggccugccugggcaaggcguacgcccagauguggagccugauguacuuccaccggcgcgaccuccggcuggccuccaacgccaucugcagcgccgugcccguccacugggugccgaccucccgcaccaccuggagcauccacgcgcaccaccaguggaugacgaccgaggacaugcugaccguguggaaccgggucuggaucgaggacaaccccuggauggaggacaagacccccgugacgaccugggagaacgugcccuaccucgggaagcgcgaggaccaguggugcggcagccugaucgggcugaccucccgggccaccugggcccagaacaucccgacggccauccagcagguccgcagccucaucggcaacgaggaguuccuggacuacaugcccuccaugaagcgguuccgcaaggaggaggagagcgagggggccaucugguga

SEQ ID NO: 9826 - RNA, 9873 nt, Artificial Sequence
  derived and/or modified CDS sequence (opt1) from DENV-3__JX669499__SS-prME
accagccugugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccggcugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccgcggcgcccggcgcauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccggagcacgacccgcauggagaaccugcuguggaagcagaucgccaacgagcucaacuacauccugugggagaacaacaucaagcugaccgugguggucggggacaucaucggcgugcucgagcagggcaagcggacccugacgccccagccgauggagcugaaguacuccuggaagaccugggggaaggccaagaucgugaccgccgagacccagaacagcuccuucaucaucgacggccccaacacgcccgagugccccagcgcgucccgcgccuggaacgucugggagguggaggacuacggguucggcguguucaccaccaacaucuggcucaagcugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccgcccgggcuaccacacccagaccgccgggcccuggcaccucggcaagcuggagcuggacuucaacuacugcgagggcacgaccguggucaucaccgagaacugcgggacccggggccccagccuccgcacgaccaccguguccgggaagcugauccacgaguggugcugccggagcugcacccugcccccgcuccgcuacaugggcgaggacgggugcugguacggcauggagauccggcccaucuccgagaaggaggagaacauggucaagagccuggucuccgccggcagcgggaagguggacaacuucacgaugggcgugcugugccucgcgauccuguucgaggaggucaugcgcgggaaguucggcaagaagcacaugaucgccgggguguucuucaccuucgugcugcuccuguccggccagaucaccuggcgggacauggcccacacccugaucaugaucggcagcaacgccuccgaccgcauggggaugggcaucacguaccucgcccugaucgcgaccuucaagauccagcccuuccuggcccucggguucuuccugcggaagcugaccagccgcgagaaccuccugcugggcgucggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccauguucacccugaccguggccuggcggacggcgacccugauccucgccggggugagccugcugccggucugccaguccagcuccaugcgcaagaccgacuggcuccccauggccguggccgccaugggcgugccgccccucccgcuguucaucuucagccucaaggacacccugaagcgccgguccuggccccugaacgagggggugauggcggugggccucgucagcauccuggccuccagccugcuccgcaacgacgugcccauggccggcccccugguggccgggggccugcucaucgccugcuacgucaucacggggaccuccgcggaccugaccguggagaaggccgccgacaucaccugggaggaggaggccgagcagacgggcgugagccacaaccugaugaucaccgucgacgacgacgggaccaugcggaucaaggacgacgagaccgagaacauccucaccgugcugcugaagacggcccuccugaucguguccggcgucuucccguacagcauccccgcgacccugcucguguggcacaccuggcagaagcagacccagcgcuccggcgugcugugggacguccccagcccgcccgagacgcagaaggccgagcuggaggaggggguguaccggaucaagcagcagggcaucuucgggaagacccaggugggcgucggggugcagaaggagggcguguuccacaccauguggcacgucacccgcggcgccgugcucacguacaacgggaagcggcuggagcccaacugggccuccgugaagaaggaccugaucagcuacggcgggggcuggcgccucuccgcgcaguggcagaagggggaggagguccaggugaucgccguggagcccggcaagaaccccaagaacuuccagaccaugcccggcaccuuccagaccacgaccggggagaucggcgccaucgcccuggacuucaagcccgggaccagcggcagccccaucaucaaccgggagggcaaggucguggggcuguacggcaacgggguggucaccaagaacggcggguacguguccggcaucgcccagacgaacgcggagccggacggccccacccccgagcuggaggaggagauguucaagaagcgcaaccucaccaucauggaccugcaccccgggagcggcaagacccggaaguaccugccggccaucgugcgcgaggccaucaagcggcgccuccggacgcugauccuggcccccacccgcgucguggccgcggagauggaggaggcccucaaggggcugcccauccgguaccagaccaccgccacgaaguccgagcacaccggccgcgagaucguggaccugaugugccacgccaccuucaccaugcggcuccugagccccguccgcgugccgaacuacaaccugaucaucauggacgaggcccacuucacggaccccgcguccaucgccgcccggggguacaucagcacccgcgugggcaugggcgaggccgcggccaucuucaugaccgccacgccgcccgggacggccgacgccuucccgcaguccaacgcgcccauccaggacgaggagcgcgacauccccgagcggagcuggaacuccggcaacgaguggaucaccgacuucgccgggaagaccgucugguucgugcccagcaucaaggccggcaacgacaucgccaacugccuccgcaagaacgggaagaaggugauccagcugucccggaagaccuucgacacggaguaccagaagaccaagcugaacgacugggacuucgucgugaccaccgacaucagcgagaugggcgccaacuucaaggcggaccgcgugaucgacccgcggcgcugccucaagcccgucauccugacggacggccccgagcgggugauccuggccgggcccaugccggugaccgccgccuccgccgcgcagcgccggggccgcgucgggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagucccgcaagacguucguggagcugaugcggcgcggggaccuccccguguggcuggcccacaaggucgccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcaccuacuccgacccgcuggcgcucaaggaguucaaggacuucgccgccggccgcaagagcaucgcccuggaccuggucacggagaucgggcgcgugcccucccaccucgcccaccggacccgcaacgcgcuggacaaccuggugaugcuccacaccagcgagcacggcgggcgggccuaccgccacgccgucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucgugcuggaguucuucaugaugguccuccugauccccgagcccgagaagcagcggacgccccaggacaaccagcuggccuacguggugaucgggauccucacgcuggccgcgaucaucgccgccaacgagaugggccugcucgagaccaccaagcgcgaccugggcauguccaaggagccgggggucgugagccccaccuccuaccuggacguggaccuccaccccgccagcgcguggacgcuguacgccgucgccaccaccgugaucacccccaugcugcggcacacgaucgagaacuccaccgccaacgugagccucgccgcgaucgccaaccaggccgucgugcugaugggccuggacaagggguggccgaucuccaagauggaccucggcgugccccugcuggcccucgggugcuacagccaggucaacccccugacccugaccgccgcggugcuccugcugaucacgcacuacgccaucaucggccccggccuccaggccaaggccacccgcgaggcccagaagcggaccgcggccgggaucaugaagaacccgaccguggacggcaucaugacgaucgaccuggaccccgucaucuacgacuccaaguucgagaagcagcugggccaggugaugcuccuggugcugugcgccguccagcuccugcugaugcgcaccagcugggcccucugcgaggcgcugacccuggccaccggccccaucacgacccucugggagggcucccccgggaaguucuggaacaccaccaucgccgugagcauggccaacaucuuccggggcuccuaccuggccggggcgggccuggccuucagcaucaugaaguccguggggacgggcaagcgcggcaccgggagccagggcgagacccucggggagaaguggaagaagaagcugaaccagcugagccggaaggaguucgaccucuacaagaaguccggcaucaccgaggucgaccgcaccgaggccaaggaggggcugaagcggggcgagaucacgcaccacgccgugagccgcggcuccgccaagcugcagugguucguggagcggaacauggucaucccggaggggcgcgugaucgaccucggcugcgggcggggcggguggagcuacuacugcgcgggccugaagaaggugaccgagguccgcggcuacaccaagggcgggcccgggcacgaggagcccgugcccauguccaccuacggcuggaacaucgugaagcugaugagcgggaaggacgucuucuaccucccgcccgagaagugcgacacgcugcugugcgacaucggcgaguccagccccucccccaccguggaggagagccgcaccauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugucccggaacagcacgcacgagauguacuggaucuccaacggcaccgggaacaucguggccagcgugaacauggucucccgccuccugcugaaccgguucaccaugacccaccgccggccgacgaucgagaaggacguggaccucggcgccggcacccgccacgugaacgccgagcccgagacccccaacauggacgucaucggggagcggaucaagcgcaucaaggaggagcacaacagcaccuggcacuacgacgacgagaacccguacaagacgugggccuaccacggcuccuacgaggugaaggcgaccgggagcgccuccagcaugaucaacggcguggucaagcugcugaccaagcccugggacgugguccccauggugacccagauggccaugacggacaccacccccuucgggcagcagcggguguucaaggagaaggucgacacccgcacgccgcggagcaugcccggcacccgccgggugaugggcaucaccgccgaguggcucuggcgcacccuggggcggaacaagaagccccgccugugcacgcgcgaggaguucaccaagaaggugcggaccaacgcggccaugggcgccgucuucaccgaggagaaccagugggacuccgccaaggccgcgguggaggacgaggacuucuggaagcucguggaccgcgagcgggagcugcacaagcuggggaagugcggcagcugcgucuacaacaugauggggaagcgcgagaagaagcucggcgaguucggcaaggccaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgcgauguacgccgacgacacggccgggugggacacccggaucaccgaggacgaccugcacaacgaggagaagaucacccagcagauggacccggagcaccgccagcucgccaacgccaucuucaagcugacguaccagaacaagguggucaaggugcagcggcccacccccaccggcaccgugauggacaucaucagccgcaaggaccagcggggcuccgggcaggucggcaccuacgggcugaacacguucaccaacauggaggcgcagcucauccgccagauggagggcgagggggugcugagcaaggccgaccuggagaacccccaccucccggagaagaagaucacccaguggcuggagaccaagggcguggagcggcugaagcgcauggccaucuccggcgacgacugcgucgugaagcccaucgacgaccgguucgccaacgcccuccuggcgcugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggccggcuggucccuccgcgagacggccugccugggcaaggcguacgcccagauguggagccugauguacuuccaccggcgcgaccuccggcuggccuccaacgccaucugcagcgccguccccgugcacugggugccgaccucccgcaccaccuggagcauccacgcgcaccaccaguggaugacgaccgaggacaugcugaccgucuggaaccggguguggaucgaggacaaccccuggauggaggacaagacccccgugacgaccugggagaacguccccuaccucgggaagcgcgaggaccaguggugcggcagccugaucgggcugaccucccgggccaccugggcccagaacaucccgacggccauccagcagguccgcagccucaucggcaacgaggaguuccuggacuacaugcccuccaugaagcgguuccgcaaggaggaggagagcgagggggccaucugguga

SEQ ID NO: 9827 - RNA, 9873 nt, Artificial Sequence
  derived and/or modified CDS sequence (opt1) from DENV-3__JX669492__SS-prME
accagcuucugccugaugaugauccuccccgcggcccuggcguuccaccugaccagccgggacggggagccgcggaugaucguggggaagaacgagcgcggcaagagccuccuguucaagaccgccuccgggaucaacaugugcacccugaucgccauggaccucggggagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccuggcgccccacgugggcauggggcucgacacccggacccagaccuggaugagcgccgagggcgccuggcgccagguggagaagguggagacgugggcccugcggcacccgggguucaccauccuggcccucuuccuggcccacuacaucggcaccucccugacccagaagguggugaucuucauccuccugaugcuggugacgcccagcaugaccaugcgcugcgugggggugggcaaccgggacuucgucgagggccucuccggggccaccuggguggacgugguccuggagcacggcgggugcgugaccacgauggccaagaacaagcccacccuggacaucgagcuccagaagaccgaggccacccagcuggcgacgcugcgcaagcucugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccuguucgggaagggcucccucgugaccugcgccaaguuccagugccuggagcccaucgagggcaaggucgugcaguacgagaaccugaaguacaccgugaucaucacgguccacaccggggaccagcaccaggugggcaacgagacccagggggucaccgccgagaucacgccccaggccagcaccaccgaggcgauccuccccgaguacggcacccuggggcuggagugcuccccgcggaccggccucgacuucaacgagaugauccugcugacgaugaagaacaaggccuggauggugcaccgccagugguucuucgaccucccccugcccuggaccagcggcgccaccaccgagacgcccaccuggaaccggaaggagcugcucgugaccuucaagaacgcccacgccaagaagcaggaggucguggugcuggggucccaggagggcgcgaugcacaccgcccugacgggggccaccgagauccagaacagcggcgggaccuccaucuucgccggccaccucaagugccgccugaagauggacaagcuggagcucaagggcaugagcuacgccaugugcaccaacacguucguccugaagaaggagguguccgagacccagcacgggaccauccugaucaagguggaguacaagggcgaggacgcgccgugcaagauccccuucagcaccgaggacgggcagggcaaggcccacaacggccggcucaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccgcggcgcccggcgcauggccauccugggcgacaccgcgugggacuucggguccgugggcggggugcugaacagccucggcaagaugguccaccagaucuucggguccgccuacacggcccuguucagcggcguguccugggugaugaagaucggcaucgggguccugcucaccuggaucggccugaacagcaagaacaccuccaugagcuucuccugcaucgccaucgggaucaucacccuguaccucggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccuggccaccgccaucgccggcgcgugggagaacggggucugcggcauccggagcacgacccgcauggagaaccuccuguggaagcagaucgccaacgagcugaacuacauccucugggagaacaacaucaagcugaccgugguggucggggacaucaucggcgugcuggagcagggcaagcggacccucacgccccagccgauggagcugaaguacuccuggaagaccugggggaaggccaagaucgugaccgccgagacccagaacagcuccuucaucaucgacggccccaacacgcccgagugccccagcgcgucccgcgccuggaacgucugggagguggaggacuacggguucggcguguucaccaccaacaucuggcugaagcuccgggaggucuacacccagcugugcgaccaccgccugaugagcgccgccgugaaggacgagcgggccgugcacgcggacaugggcuacuggaucgagagccagaagaacggguccuggaagcucgagaaggccagccugaucgaggucaagaccugcacguggccgaagucccacacccuguggagcaacggcgugcucgaguccgacaugaucauccccaagagccuggccgggcccaucucccagcacaaccaccgcccgggcuaccacacccagaccgccgggcccuggcaccugggcaagcucgagcuggacuucaacuacugcgagggcacgaccguggucaucaccgagaacugcgggacccggggccccagccugcgcacgaccaccguguccgggaagcucauccacgaguggugcugccggagcugcacccugcccccgcugcgcuacaugggcgaggacgggugcugguacggcauggagauccggcccaucuccgagaaggaggagaacauggucaagagccucgucuccgccggcagcgggaagguggacaacuucacgaugggcgugcugugccuggcgauccucuucgaggaggucaugcgcgggaaguucggcaagaagcacaugaucgccgggguguucuucaccuucgugcugcugcucuccggccagaucaccuggcgggacauggcccacacccugaucaugaucggcagcaacgccuccgaccgcauggggaugggcgucacguaccuggcccucaucgcgaccuucaagauccagcccuuccuggcccugggguucuuccuccggaagcugaccagccgcgagaaccugcuccugggcgugggccuggccauggccaccacgcuccagcugcccgaggacaucgagcagauggcgaacgggaucgcccugggccucauggcccugaagcugaucacccaguucgagaccuaccagcucuggaccgcccugaucagccugacgugcuccaacaccauguucacccucaccguggccuggcggacggcgacccugauccuggccggggucagccuccugccggugugccaguccagcuccaugcgcaagaccgacuggcugcccauggccgucgccgccaugggcgugccgccccucccgcuguucaucuucagccugaaggacacccucaagcgccgguccuggccccugaacgagggggugauggcggucggccuggugagcauccucgccuccagccugcugcgcaacgacgugcccauggccggcccccucgucgccgggggccugcugaucgccugcuacgugaucacggggaccuccgcggaccucaccguggagaaggccgccgacaucaccugggaggaggaggccgagcagacgggcgucagccacaaccugaugaucaccguggacgacgacgggaccaugcggaucaaggacgacgagaccgagaacauccugaccgugcuccugaagacggcccugcucaucgucuccggcguguucccguacagcauccccgcgacccugcugguguggcacaccuggcagaagcagacccagcgcuccggcguccucugggacgugcccagcccgcccgagacgcagaaggccgagcuggaggaggggguguaccggaucaagcagcagggcaucuucgggaagacccaggucggcgugggggugcagaaggagggcgucuuccacaccauguggcacgugacccgcggcgccgugcugacguacaacgggaagcggcucgagcccaacugggccuccgucaagaaggaccugaucagcuacggcgggggcuggcgccuguccgcgcaguggcagaagggggaggagguccaggugaucgccgucgagcccggcaagaaccccaagaacuuccagaccaugcccggcaccuuccagaccacgaccggggagaucggcgccaucgcccucgacuucaagcccgggaccagcggcagccccaucaucaaccgggagggcaaggugguggggcuguacggcaacggggucgugaccaagaacggcggguacguguccggcaucgcccagacgaacgcggagccggacggccccacccccgagcuggaggaggagauguucaagaagcgcaaccugaccaucauggaccuccaccccgggagcggcaagacccggaaguaccugccggccaucguccgcgaggccaucaagcggcgccugcggacgcucauccuggcccccacccgcgugguggccgcggagauggaggaggcccugaaggggcuccccauccgguaccagaccaccgccacgaaguccgagcacaccggccgcgagaucgucgaccugaugugccacgccaccuucaccaugcggcugcucagccccgugcgcgugccgaacuacaaccugaucaucauggacgaggcccacuucacggaccccgcguccaucgccgcccggggguacaucagcacccgcgucggcaugggcgaggccgcggccaucuucaugaccgccacgccgcccgggacggccgacgccuucccgcaguccaacgcgcccauccaggacgaggagcgcgacauccccgagcggagcuggaacuccggcaacgaguggaucaccgacuucgccgggaagaccgugugguucgugcccagcaucaaggccggcaacgacaucgccaacugccugcgcaagaacgggaagaaggucauccagcucucccggaagaccuucgacacggaguaccagaagaccaagcugaacgacugggacuucguggugaccaccgacaucagcgagaugggcgccaacuucaaggcggaccgcgucaucgacccgcggcgcugccugaagcccgugauccucacggacggccccgagcgggugauccuggccgggcccaugccggucaccgccgccuccgccgcgcagcgccggggccgcguggggcggaacccccagaaggagaacgaccaguacaucuucaccggccagccccugaacaacgacgaggaccacgcccacuggaccgaggccaagaugcuccuggacaacaucaacacccccgaggggaucaucccggcccuguucgagcccgagcgcgagaaguccgcggccaucgacggcgaguaccggcucaagggcgagucccgcaagacguucguggagcugaugcggcgcggggaccugcccgucuggcucgcccacaagguggccagcgagggcaucaaguacaccgaccggaaguggugcuucgacgggcagcgcaacaaccagauccuggaggagaacauggacgucgagaucuggaccaaggagggcgagaagaagaagcugcggccccgcuggcucgacgcccgcaccuacuccgacccgcuggcgcugaaggaguucaaggacuucgccgccggccgcaagagcaucgcccucgaccuggugacggagaucgggcgcgugcccucccaccuggcccaccggacccgcaacgcgcucgacaaccuggucaugcugcacaccagcgagcacggcgggcgggccuaccgccacgccguggaggagcuccccgagaccauggagacgcugcugcuccugggccugaugauccuccugaccgggggcgccaugcuguuccucaucagcggcaaggggaucggcaagaccuccaucgggcugaucugcgugaucgccagcuccggcaugcuguggauggcggagaucccgcuccaguggaucgccagcgccaucguccuggaguucuucaugauggugcugcucauccccgagcccgagaagcagcggacgccccaggacaaccagcuggccuacguggucaucgggauccugacgcucgccgcgaucaucgccgccaacgagaugggccugcuggagaccaccaagcgcgaccucggcauguccaaggagccggggguggugagccccaccuccuaccuggacgucgaccugcaccccgccagcgcguggacgcucuacgccguggccaccaccgugaucacccccaugcugcggcacacgaucgagaacuccaccgccaacgucagccuggccgcgaucgccaaccaggccguggugcucaugggccuggacaagggguggccgaucuccaagauggaccugggcgucccccuccuggcccuggggugcuacagccaggugaacccccucacccugaccgccgcggugcugcuccugaucacgcacuacgccaucaucggccccggccugcaggccaaggccacccgcgaggcccagaagcggaccgcggccgggaucaugaagaacccgaccgucgacggcaucaugacgaucgaccucgaccccgugaucuacgacuccaaguucgagaagcagcugggccaggugaugcugcucguccugugcgccgugcagcugcuccugaugcgcaccagcugggcccugugcgaggcgcucacccuggccaccggccccaucacgacccugugggagggcucccccgggaaguucuggaacaccaccaucgccgugagcauggccaacaucuuccggggcuccuaccucgccggggcgggccuggccuucagcaucaugaaguccgucgggacgggcaagcgcggcaccgggagccagggcgagacccugggggagaaguggaagaagaagcucaaccagcugagccggaaggaguucgaccuguacaagaaguccggcaucaccgagguggaccgcaccgaggccaaggaggggcucaagcggggcgagaucacgcaccacgccgugagccgcggcuccgccaagcugcagugguucgucgagcggaacauggugaucccggaggggcgcgugaucgaccugggcugcgggcggggcggguggagcuacuacugcgcgggccucaagaaggucaccgaggugcgcggcuacaccaagggcgggcccgggcacgaggagcccgugcccauguccaccuacggcuggaacaucgucaagcugaugagcgggaaggacguguucuaccugccgcccgagaagugcgacacgcuccugugcgacaucggcgaguccagccccucccccaccguggaggagagccgcaccauccggguccugaagaugguggagccguggcugaagaacaaccaguucugcaucaaggugcucaaccccuacaugcccaccgucaucgagcaccuggagcgccugcagcggaagcacggcgggaugcucgugcgcaacccccugucccggaacagcacgcacgagauguacuggaucuccaacggcaccgggaacaucguggccagcgucaacauggugucccgccugcuccugaaccgguucaccaugacccaccgccggccgacgaucgagaaggacguggaccugggcgccggcacccgccacgucaacgccgagcccgagacccccaacauggacgugaucggggagcggaucaagcgcaucaaggaggagcacaacagcaccuggcacuacgacgacgagaacccguacaagacgugggccuaccacggcuccuacgaggugaaggcgaccgggagcgccuccagcaugaucaacggcgucgugaagcuccugaccaagcccugggacgucgugcccauggugacccagauggccaugacggacaccacccccuucgggcagcagcgggucuucaaggagaagguggacacccgcacgccgcggagcaugcccggcacccgccgggugaugggcaucaccgccgaguggcuguggcgcacccucgggcggaacaagaagccccgccugugcacgcgcgaggaguucaccaagaagguccggaccaacgcggccaugggcgccguguucaccgaggagaaccagugggacuccgccaaggccgcgguggaggacgaggacuucuggaagcuggucgaccgcgagcgggagcuccacaagcuggggaagugcggcagcugcguguacaacaugauggggaagcgcgagaagaagcugggcgaguucggcaaggccaaggggucccgggccaucugguacauguggcucggcgcccgcuaccuggaguucgaggcccugggguuccucaacgaggaccacugguucagccgggagaacuccuacagcggcguggagggggagggccugcacaagcugggcuacauccuccgcgacaucuccaagauccccgggggcgcgauguacgccgacgacacggccgggugggacacccggaucaccgaggacgaccugcacaacgaggagaagaucacccagcagauggacccggagcaccgccagcuggccaacgccaucuucaagcucacguaccagaacaaggucgugaaggugcagcggcccacccccaccggcaccgucauggacaucaucagccgcaaggaccagcggggcuccggccaggugggcaccuacgggcugaacacguucaccaacauggaggcgcagcugauccgccagauggagggcgagggggugcucagcaaggccgaccuggagaacccccaccuccccgagaagaagaucacccaguggcuggagaccaagggcgucgagcggcugaagcgcauggccaucuccggcgacgacugcguggugaagcccaucgacgaccgguucgccaacgcccugcucgcgcugaacgacauggggaagguccgcaaggacaucccccaguggcagcccagcaagggcuggcacgacuggcagcaggucccguucugcucccaccacuuccacgagcugaucaugaaggacgggcggaagcucgugguccccugccgcccccaggacgagcugaucggccgggcccgcaucagccagggggccggcuggucccugcgcgagacggccugccucggcaaggcguacgcccagauguggagccugauguacuuccaccggcgcgaccugcggcucgccuccaacgccaucugcagcgccgugcccgugcacugggucccgaccucccgcaccaccuggagcauccacgcgcaccaccaguggaugacgaccgaggacaugcugaccguguggaaccggguguggaucgaggacaaccccuggauggaggacaagacccccgucacgaccugggagaacgugcccuaccuggggaagcgcgaggaccaguggugcggcagccucaucgggcugaccucccgggccaccugggcccagaacaucccgacggccauccagcagguccgcagccugaucggcaacgaggaguuccucgacuacaugcccuccaugaagcgguuccgcaaggaggaggagagcgagggggccaucugguga

SEQ ID NO: 9828 - RNA, 9873 nt, Artificial Sequence
  derived and/or modified CDS sequence (opt1) from DENV-3__JX669500__SS-prME
accagccugugccucaugaugauccugcccgccgcccuggcguuccaccucaccagccgggacggggagccgcggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggugaucuucauccugcugaugcucgugacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccggcugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccgcggcgcccggcgcauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccggagcacgacccgcauggagaaccugcuguggaagcagaucgccaacgagcucaacuacauccugugggagaacaacaucaagcugaccgugguggucggggacaucaucggcgugcucgagcagggcaagcggacccugacgccccagccgauggagcugaaguacuccuggaagaccugggggaaggccaagaucgugaccgccgagacccagaacagcuccuucaucaucgacggccccaacacgcccgagugccccagcgcgucccgcgccuggaacgucugggagguggaggacuacggguucggcguguucaccaccaacaucuggcucaagcugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccgcccgggcuaccacacccagaccgccgggcccuggcaccucggcaagcuggagcuggacuucaacuacugcgagggcacgaccguggucaucaccgagaacugcgggacccggggccccagccuccgcacgaccaccguguccgggaagcugauccacgaguggugcugccggagcugcacccugcccccgcuccgcuacaugggcgaggacgggugcugguacggcauggagauccggcccaucuccgagaaggaggagaacauggucaagagccuggucuccgccggcagcgggaagguggacaacuucacgaugggcgugcugugccucgcgauccuguucgaggaggucaugcgcgggaaguucggcaagaagcacaugaucgccgggguguucuucaccuucgugcugcuccuguccggccagaucaccuggcgggacauggcccacacccugaucaugaucggcagcaacgccuccgaccgcauggggaugggcgucacguaccucgcccugaucgcgaccuucaagauccagcccuuccuggcccucggguucuuccugcggaagcugaccagccgcgagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccauguucacccugaccguggccuggcggacggcgacccugauccucgccggggucagccugcugccggugugccaguccagcuccaugcgcaagaccgacuggcuccccauggccgucgccgccaugggcgugccgccccucccgcuguucaucuucagccucaaggacacccugaagcgccgguccuggccccugaacgagggggugauggcggucggccucgugagcauccuggccuccagccugcuccgcaacgacgugcccauggccggcccccuggucgccgggggccugcucaucgccugcuacgugaucacggggaccuccgcggaccugaccguggagaaggccgccgacaucaccugggaggaggaggccgagcagacgggcgucagccacaaccugaugaucaccguggacgacgacgggaccaugcggaucaaggacgacgagaccgagaacauccucaccgugcugcugaagacggcccuccugaucgucuccggcguguucccguacagcauccccgcgacccugcucguguggcacaccuggcagaagcagacccagcgcuccggcguccugugggacgugcccagcccgcccgagacgcagaaggccgagcuggaggaggggguguaccggaucaagcagcagggcaucuucgggaagacccaggucggcgugggggugcagaaggagggcgucuuccacaccauguggcacgugacccgcggcgccgugcucacguacaacgggaagcggcuggagcccaacugggccuccgucaagaaggaccugaucagcuacggcgggggcuggcgccucuccgcgcaguggcagaagggggaggagguccaggugaucgccgucgagcccggcaagaaccccaagaacuuccagaccaugcccggcaccuuccagaccacgaccggggagaucggcgccaucgcccuggacuucaagcccgggaccagcggcagccccaucaucaaccgggagggcaaggugguggggcuguacggcaacggggucgugaccaagaacggcggguacguguccggcaucgcccagacgaacgcggagccggacggccccacccccgagcuggaggaggagauguucaagaagcgcaaccucaccaucauggaccugcaccccgggagcggcaagacccggaaguaccugccggccaucguccgcgaggccaucaagcggcgccuccggacgcugauccuggcccccacccgcgugguggccgcggagauggaggaggcccucaaggggcugcccauccgguaccagaccaccgccacgaaguccgagcacaccggccgcgagaucgucgaccugaugugccacgccaccuucaccaugcggcuccugagccccgugcgcgugccgaacuacaaccugaucaucauggacgaggcccacuucacggaccccgcguccaucgccgcccggggguacaucagcacccgcgucggcaugggcgaggccgcggccaucuucaugaccgccacgccgcccgggacggccgacgccuucccgcaguccaacgcgcccauccaggacgaggagcgcgacauccccgagcggagcuggaacuccggcaacgaguggaucaccgacuucgccgggaagaccgugugguucgugcccagcaucaaggccggcaacgacaucgccaacugccuccgcaagaacgggaagaaggucauccagcugucccggaagaccuucgacacggaguaccagaagaccaagcugaacgacugggacuucguggugaccaccgacaucagcgagaugggcgccaacuucaaggcggaccgcgucaucgacccgcggcgcugccucaagcccgugauccugacggacggccccgagcgggugauccuggccgggcccaugccggucaccgccgccuccgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagucccgcaagacguucguggagcugaugcggcgcggggaccuccccgucuggcuggcccacaagguggccagcgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccgcaccuacuccgacccgcuggcgcucaaggaguucaaggacuucgccgccggccgcaagagcaucgcccuggaccuggugacggagaucgggcgcgugcccucccaccucgcccaccggacccgcaacgcgcuggacaaccuggucaugcuccacaccagcgagcacggcgggcgggccuaccgccacgccguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucguccuggaguucuucaugauggugcuccugauccccgagcccgagaagcagcggacgccccaggacaaccagcuggccuacguggucaucgggauccucacgcuggccgcgaucaucgccgccaacgagaugggccugcucgagaccaccaagcgcgaccugggcauguccaaggagccggggguggugagccccaccuccuaccuggacgucgaccuccaccccgccagcgcguggacgcuguacgccguggccaccaccgugaucacccccaugcugcggcacacgaucgagaacuccaccgccaacgucagccucgccgcgaucgccaaccaggccguggugcugaugggccuggacaagggguggccgaucuccaagauggaccucggcgucccccugcuggcccucgggugcuacagccaggugaacccccugacccugaccgccgcggugcuccugcugaucacgcacuacgccaucaucggccccggccuccaggccaaggccacccgcgaggcccagaagcggaccgcggccgggaucaugaagaacccgaccgucgacggcaucaugacgaucgaccuggaccccgugaucuacgacuccaaguucgagaagcagcugggccaggugaugcuccugguccugugcgccgugcagcuccugcugaugcgcaccagcugggcccucugcgaggcgcugacccuggccaccggccccaucacgacccucugggagggcucccccgggaaguucuggaacaccaccaucgccgugagcauggccaacaucuuccggggcuccuaccuggccggggcgggccuggccuucagcaucaugaaguccgucgggacgggcaagcgcggcaccgggagccagggcgagacccucggggagaaguggaagaagaagcugaaccagcugagccggaaggaguucgaccucuacaagaaguccggcaucaccgagguggaccgcaccgaggccaaggaggggcugaagcggggcgagaucacgcaccacgccgugagccgcggcuccgccaagcugcagugguucgucgagcggaacauggugaucccggaggggcgcgugaucgaccucggcugcgggcggggcggguggagcuacuacugcgcgggccugaagaaggucaccgaggugcgcggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccggguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacgcacgagauguacuggaucuccaacggcaccgggaacaucguggccagcgucaacauggugucccgccuccugcugaaccgguucaccaugacccaccgccggccgacgaucgagaaggacguggaccucggcgccggcacccgccacgucaacgccgagcccgagacccccaacauggacgugaucggggagcggaucaagcgcaucaaggaggagcacaacagcaccuggcacuacgacgacgagaacccguacaagacgugggccuaccacggcuccuacgaggugaaggcgaccgggagcgccuccagcaugaucaacggcgucgugaagcugcugaccaagcccugggacgucgugcccauggugacccagauggccaugacggacaccacccccuucgggcagcagcgggucuucaaggagaagguggacacccgcacgccgcggcccaugcccggcacccgccgggugaugggcaucaccgccgaguggcucuggcgcacccuggggcggaacaagaagccccgccugugcacgcgcgaggaguucaccaagaagguccggaccaacgcggccaugggcgccguguucaccgaggagaaccagugggacagcgccaaggccgcgguggaggacgaggacuucuggaagcucgucgaccgcgagcgggagcugcacaagcuggggaagugcggcuccugcguguacaacaugauggggaagcgcgagaagaagcucggcgaguucggcaaggccaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccggcggggcgauguacgccgacgacacggccgggugggacacccggaucaccgaggacgaccugcacaacgaggagaagaucacccagcagauggaccccgagcaccgccagcucgccaacgccaucuucaagcugacguaccagaacaaggucgugaaggugcagcggcccacccccaccgggaccgucauggacaucaucucccgcaaggaccagcggggcagcggccaggugggcaccuacgggcugaacacguucaccaacauggaggcgcagcucauccgccagauggagggcgagggggugcuguccaaggccgaccuggagaacccgcaccuccccgagaagaagaucacccaguggcuggagaccaagggcgucgagcggcugaagcgcauggccaucagcggcgacgacugcguggugaagcccaucgacgaccgguucgccaacgcccuccuggcgcugaacgacauggggaagguccgcaaggacaucccccaguggcagccguccaagggcuggcacgacuggcagcagguccccuucugcagccaccacuuccacgagcucaucaugaaggacgggcggaagcuggugguccccugccgcccccaggacgagcugaucggccgggcccgcaucucccagggggccggcuggagccuccgcgagacggccugccugggcaaggcguacgcccagauguggucccugauguacuuccaccggcgcgaccuccggcuggccagcaacgccaucugcuccgccgugccggugcacuggguccccaccagccgcaccaccugguccauccacgcgcaccaccaguggaugacgaccgaggacaugcugaccguguggaaccggguguggaucgaggacaaccccuggauggaggacaagacccccgucacgaccugggagaacgugccguaccucgggaagcgcgaggaccaguggugcggcagccugaucgggcugaccagccgggccaccugggcccagaacauccccacggccauccagcagguccgcucccucaucggcaacgaggaguuccuggacuacaugcccagcaugaagcgguuccgcaaggaggaggaguccgagggggccaucugguga

SEQ ID NO: 9829 - RNA, 9873 nt, Artificial Sequence
  derived and/or modified CDS sequence (opt1) from DENV-3__JX669497__SS-prME
accagccugugccucaugaugauccugcccgccgcccuggcguuccaccucaccagccgcgacggggagccgcggaugaucguggggaagaacgagcgcggcaagagccugcuguucaagaccgccagcgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccggcugaucacggccaaccccgucgugaccaagaaggaggagcccgugaacaucgaggccgagccgcccuucggggagagcaacaucgucaucggcaucggggacaacgcguccaagaucaacugguacaagaagggcagcuccaucgggaagauguucgaggccaccgcccgcggcgcccggcgcauggccauccugggcgacaccgcgugggacuucgggagcgugggcggggugcugaacucccucggcaagaugguccaccagaucuucgggagcgccuacacggcccuguucuccggcgugagcugggugaugaagaucggcaucgggguccugcucaccuggaucggccugaacuccaagaacaccagcauguccuucagcugcaucgccaucgggaucaucacccuguaccucggcgccguggugcaggcggacauggggugcgucaucaacuggaagggcaaggagcugaagugcggcuccgggaucuucgugacgaacgaggugcacaccuggaccgagcaguacaaguuccaggccgacagccccaagcgccuggccaccgccaucgccggcgcgugggagaacggggucugcggcauccgguccacgacccgcauggagaaccuccuguggaagcagaucgccaacgagcugaacuacauccucugggagaacaacaucaagcugaccgugguggucggggacaucaucggcgugcuggagcagggcaagcggacccucacgccccagccgauggagcugaaguacagcuggaagaccugggggaaggccaagaucgugaccgccgagacccagaacuccagcuucaucaucgacggccccaacacgcccgagugccccuccgcgagccgcgccuggaacgucugggagguggaggacuacggguucggcguguucaccaccaacaucuggcugaagcuccgggaggucuacacccagcugugcgaccaccgccugaugagcgccgccgugaaggacgagcgggccgugcacgcggacaugggcuacuggaucgagucccagaagaacgggagcuggaagcucgagaaggccucccugaucgaggucaagaccugcacguggcccaagucccacacccugugguccaacggcgugcucgagagcgacaugaucauccccaagucccuggccgggcccaucagccagcacaaccaccgcccgggcuaccacacccagaccgccgggcccuggcaccugggcaagcucgagcuggacuucaacuacugcgagggcacgaccguggucaucaccgagaacugcgggacccggggccccucccugcgcacgaccaccgugagcgggaagcucauccacgaguggugcugccgguccugcacccugcccccgcugcgcuacaugggcgaggacgggugcugguacggcauggagauccggcccaucagcgagaaggaggagaacauggugaagucccucgucagcgccggcuccgggaagguggacaacuucacgaugggcgugcugugccuggcgauccucuucgaggaggucaugcgcgggaaguucggcaagaagcacaugaucgccgggguguucuucaccuucgugcugcugcucagcggccagaucaccuggcgggacauggcccacacccugaucaugaucggcuccaacgccagcgaccgcauggggaugggcgucacguaccuggcccucaucgcgaccuucaagauccagcccuuccuggcccugggguucuuccuccggaagcugaccagccgcgagaaccugcuccugggcgugggccuggccauggccaccacgcuccagcugcccgaggacaucgagcagauggcgaacgggaucgcccugggccucauggcccugaagcugaucacccaguucgagaccuaccagcucuggaccgcccugaucucccugacgugcagcaacaccauguucacccucaccguggccuggcggacggcgacccugauccuggccggggucucccuccugccggugugccagagcuccagcaugcgcaagaccgacuggcugcccauggccgucgccgccaugggcgugccgccccugccgcuguucaucuucucccugaaggacacccucaagcgccggagcuggccccugaacgagggggugauggcggucggccugguguccauccucgccagcucccugcugcgcaacgacgugcccauggccggcccccucgucgccgggggccugcugaucgccugcuacgugaucacggggaccagcgcggaccucaccguggagaaggccgccgacaucaccugggaggaggaggccgagcagacgggcgucucccacaaccugaugaucaccguggacgacgacgggaccaugcggaucaaggacgacgagaccgagaacauccugaccgugcuccugaagacggcccugcucaucgucagcggcguguucccguacuccauccccgcgacccugcugguguggcacaccuggcagaagcagacccagcgcagcggcguccucugggacgugcccagcccgcccgagacgcagaaggccgagcuggaggaggggguguaccggaucaagcagcagggcaucuucgggaagacccaggucggcgugggggugcagaaggagggcgucuuccacaccauguggcacgugacccgcggcgccgugcugacguacaacgggaagcggcucgagcccaacugggccagcgucaagaaggaccugaucuccuacggcgggggcuggcgccugagcgcgcaguggcagaagggggaggagguccaggugaucgccgucgagcccggcaagaaccccaagaacuuccagaccaugcccggcaccuuccagaccacgaccggggagaucggcgccaucgcccucgacuucaagcccgggaccagcggcucccccaucaucaaccgggagggcaaggugguggggcuguacggcaacggggucgugaccaagaacggcggguacgugagcggcaucgcccagacgaacgcggagccggacggccccacccccgagcuggaggaggagauguucaagaagcgcaaccugaccaucauggaccuccaccccggguccggcaagacccggaaguaccugccggccaucguccgcgaggccaucaagcggcgccugcggacgcucauccuggcccccacccgcgugguggccgcggagauggaggaggcccugaaggggcuccccauccgguaccagaccaccgccaccaagagcgagcacaccggccgcgagaucgucgaccugaugugccacgccaccuucaccaugcggcugcucucccccgugcgcgugccgaacuacaaccugaucaucauggacgaggcccacuucacggaccccgcgagcaucgccgcccggggguacaucuccacccgcgucggcaugggcgaggccgcggccaucuucaugaccgccacgccgcccgggacggccgacgccuucccgcagagcaacgcgcccauccaggacgaggagcgcgacauccccgagcgguccuggaacagcggcaacgaguggaucaccgacuucgccgggaagaccgugugguucgugcccuccaucaaggccggcaacgacaucgccaacugccugcgcaagaacgggaagaaggucauccagcucagccggaagaccuucgacacggaguaccagaagaccaagcugaacgacugggacuucguggugaccaccgacaucuccgagaugggcgccaacuucaaggcggaccgcgucaucgacccgcggcgcugccugaagcccgugauccucacggacggccccgagcgggugauccuggccgggcccaugccggucaccgccgccagcgccgcgcagcgccggggccgcguggggcggaacccccagaaggagaacgaccaguacaucuucaccggccagccccugaacaacgacgaggaccacgcccacuggaccgaggccaagaugcuccuggacaacaucaacacccccgaggggaucaucccggcccuguucgagcccgagcgcgagaaguccgcggccaucgacggcgaguaccggcucaagggcgagagccgcaagacguucguggagcugaugcggcgcggggaccugcccgucuggcucgcccacaagguggccuccgagggcaucaaguacaccgaccggaaguggugcuucgacgggcagcgcaacaaccagauccuggaggagaacauggacgucgagaucuggaccaaggagggcgagaagaagaagcugcggccccgcuggcucgacgcccgcaccuacagcgacccgcuggcgcugaaggaguucaaggacuucgccgccggccggaaguccaucgcccucgaccuggugacggagaucgggcgcgugcccagccaccuggcccaccggacccgcaacgcgcucgacaaccuggucaugcugcacaccagcgagcacggcgggcgggccuaccgccacgccguggaggagcuccccgagaccauggagacgcugcugcuccugggccugaugauccuccugaccgggggcgccaugcuguuccucaucuccggcaaggggaucggcaagaccagcaucgggcugaucugcgugaucgccuccagcggcaugcuguggauggcggagaucccgcuccaguggaucgccuccgccaucguccuggaguucuucaugauggugcugcucauccccgagcccgagaagcagcggacgccccaggacaaccagcuggccuacguggucaucgggauccugacgcucgccgcgaucaucgccgccaacgagaugggccugcuggagaccaccaagcgcgaccucggcaugagcaaggagccggggguggugucccccaccagcuaccuggacgucgaccugcaccccgccuccgcguggacgcucuacgccguggccaccaccgugaucacccccaugcugcggcacacgaucgagaacagcaccgccaacgucucccuggccgcgaucgccaaccaggccguggugcucaugggccuggacaagggguggccgaucagcaagauggaccugggcgucccccuccuggcccuggggugcuacucccaggugaacccccucacccugaccgccgcggugcugcuccugaucacgcacuacgccaucaucggccccggccugcaggccaaggccacccgcgaggcccagaagcggaccgcggccgggaucaugaagaacccgaccgucgacggcaucaugacgaucgaccucgaccccgugaucuacgacagcaaguucgagaagcagcugggccaggugaugcugcucguccugugcgccgugcagcugcuccugaugcgcaccuccugggcccugugcgaggcgcucacccuggccaccggccccaucacgacccugugggagggcagccccgggaaguucuggaacaccaccaucgccguguccauggccaacaucuuccggggcagcuaccucgccggggcgggccuggccuucuccaucaugaaguccgucgggacgggcaagcgcggcaccgggagccagggcgagacccugggggagaaguggaagaagaagcucaaccagcugucccggaaggaguucgaccuguacaagaaguccggcaucaccgagguggaccgcaccgaggccaaggaggggcucaagcggggcgagaucacgcaccacgccgugucccgcggcagcgccaagcugcagugguucgucgagcggaacauggugaucccggaggggcgcgugaucgaccugggcugcgggcggggcgggugguccuacuacugcgcgggccucaagaaggucaccgaggugcgcggcuacaccaagggcgggcccgggcacgaggagcccgugcccaugagcaccuacggcuggaacaucgucaagcugauguccgggaaggacguguucuaccugccgcccgagaagugcgacacgcuccugugcgacaucggcgagagcucccccagccccaccguggaggagucccgcaccauccggguccugaagaugguggagccguggcugaagaacaaccaguucugcaucaaggugcucaaccccuacaugcccaccgucaucgagcaccuggagcgccugcagcggaagcacggcgggaugcucgugcgcaacccccugagccggaacuccacgcacgagauguacuggaucagcaacggcaccgggaacaucguggccuccgucaacauggugagccgccugcuccugaaccgguucaccaugacccaccgccggccgacgaucgagaaggacguggaccugggcgccggcacccgccacgucaacgccgagcccgagacccccaacauggacgugaucggggagcggaucaagcgcaucaaggaggagcacaacuccaccuggcacuacgacgacgagaacccguacaagacgugggccuaccacggcagcuacgaggugaaggcgaccggguccgccagcagcaugaucaacggcgucgugaagcuccugaccaagcccugggacgucgugcccauggugacccagauggccaugacggacaccacccccuucgggcagcagcgggucuucaaggagaagguggacacccgcacgccgcgguccaugcccggcacccgccgggugaugggcaucaccgccgaguggcuguggcgcacccucgggcggaacaagaagccccgccugugcacgcgcgaggaguucaccaagaagguccggaccaacgcggccaugggcgccguguucaccgaggagaaccagugggacagcgccaaggccgcgguggaggacgaggacuucuggaagcuggucgaccgcgagcgggagcuccacaagcuggggaagugcggcuccugcguguacaacaugauggggaagcgcgagaagaagcugggcgaguucggcaaggccaaggggagccgggccaucugguacauguggcucggcgcccgcuaccuggaguucgaggcccugggguuccucaacgaggaccacugguucucccgggagaacagcuacuccggcguggagggggagggccugcacaagcugggcuacauccuccgcgacaucagcaagauccccgggggcgcgauguacgccgacgacacggccgggugggacacccggaucaccgaggacgaccugcacaacgaggagaagaucacccagcagauggacccggagcaccgccagcuggccaacgccaucuucaagcucacguaccagaacaaggucgugaaggugcagcggcccacccccaccggcaccgucauggacaucaucucccgcaaggaccagcggggcagcggccaggugggcaccuacgggcugaacacguucaccaacauggaggcgcagcugauccgccagauggagggcgagggggugcucuccaaggccgaccuggagaacccccaccucccggagaagaagaucacccaguggcucgagaccaagggcgucgagcggcugaagcgcauggccaucagcggcgacgacugcguggugaagcccaucgacgaccgguucgccaacgcccugcucgcgcugaacgacauggggaagguccgcaaggacaucccccaguggcagcccuccaagggcuggcacgacuggcagcaggucccguucugcagccaccacuuccacgagcugaucaugaaggacgggcggaagcucgugguccccugccgcccccaggacgagcugaucggccgggcccgcaucucccagggggccggcuggagccugcgcgagacggccugccucggcaaggcguacgcccagauguggucccugauguacuuccaccggcgcgaccugcggcucgccagcaacgccaucugcuccgccgugcccgugcacugggucccgaccagccgcaccaccuggagcauccacgcgcaccaccaguggaugacgaccgaggacaugcugaccguguggaaccggguguggaucgaggacaaccccuggauggaggacaagacccccgucacgaccugggagaacgugcccuaccuggggaagcgcgaggaccaguggugcggcucccucaucgggcugaccagccgggccaccugggcccagaacaucccgacggccauccagcagguccgcucccugaucggcaacgaggaguuccucgacuacaugcccagcaugaagcgguuccgcaaggaggaggaguccgagggggccaucugguga

SEQ ID NO: 9830 - RNA, 9873 nt, Artificial Sequence
  derived and/or modified CDS sequence (opt1) from DENV-3__JX669501__SS-prME
accagccucugccucaugaugauccugcccgccgcccuggcguuccaccucaccagccgggacggggagccccggaugaucguggggaagaacgagcgcggcaagagccugcuguucaagacggccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucguccugaagaaggagguguccgagacccagcacgggaccauccucaucaagguggaguaccggggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucgugaacuggaagggcaaggagcugaagugcggcagcgggaucuucgugacgaacgagguccacaccuggaccgagcaguacaaguuccaggccgacucccccaagcggcucgccaccgccaucgccggcgcgugggagaacggggugugcggcauccgcagcacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgcgucccgggccuggaacgugugggagguggaggacuacggguucggcgucuucaccaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgcgauccuguucgaggaggugaugcgggggaaguucggcaagaagcacaugaucgccgggguguucuucaccuucguccugcuccuguccggccagaucaccuggcgcgacauggcccacacccugacgaugaucggcagcaacgccuccgaccggauggggaugggcgugaccuaccucgcccugaucgcgaccuucaagauccagcccuuccuggcccucggguucuuccugcgcaagcugaccagccgggagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccauguucacccugacggucgccuggcgcaccgcgacccugauccucgccggggugagccugcugccggucugccaguccagcuccaugcgcaagaccgacuggcuccccauggccguggccgccaugggcgugccgccccucccgcuguucaucuucagccucaaggacacgcugaagcggcgcuccuggccccugaacgagggggucauggcggugggccucgugagcauccuggccuccagccugcuccggaacgacguccccauggccggcccccugguggccgggggccugcucaucgccugcuacgugaucaccgggaccuccgcggaccugaccgucgagaaggccgccgacaucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcguguucccguacagcauccccgcgacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgccguccucaccuacaacgggaagcgccuggagcccaacugggccuccgugaagaaggaccugaucagcuacggcgggggcuggcggcucuccgcgcaguggcagaagggggaggaggugcaggucaucgccguggagcccggcaagaaccccaagaacuuccagaccaugcccggcaccuuccagacgaccaccggggagaucggcgccaucgcccuggacuucaagcccgggaccagcggcagccccaucaucaaccgcgagggcaagguggucgggcuguacggcaacgggguggugacgaagaacggcggguacgucuccggcaucgcccagaccaacgcggagccggacggccccacccccgagcuggaggaggagauguucaagaagcggaaccucaccaucauggaccugcaccccgggagcggcaagacgcgcaaguaccugccggccaucgugcgggaggccaucaagcgccggcuccgcacccugauccuggcccccacccggguggucgccgcggagauggaggaggcccucaaggggcugcccauccgcuaccagaccacggccaccaaguccgagcacaccggccgggagaucguggaccugaugugccacgccaccuucacgaugcgccuccugagccccgugcgggucccgaacuacaaccugaucaucauggacgaggcccacuucaccgaccccgcguccaucgccgcccgcggguacaucagcacccgcgugggcaugggcgaggccgcggccaucuucaugaccgccacgccgcccgggaccgccgacgccuucccgcaguccaacgcgcccauccaggacgaggagcgggacauccccgagcgcagcuggaacuccggcaacgaguggaucaccgacuucgccgggaagaccgugugguucguccccagcaucaaggccggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggcggaccgggugaucgacccgcgccggugccucaagcccgugauccugaccgacggccccgagcgcgucauccuggccgggcccaugccggugaccgccgccuccgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgggagaaguccgcggccaucgacggcgaguaccgccugaagggcgagucccggaagaccuucgucgagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgcuggcuggacgcccggacguacuccgacccgcuggcgcucaaggaguucaaggacuucgccgccggccgcaagagcaucgcccuggaccuggugaccgagaucgggcggguccccucccaccucgcccaccgcacccggaacgcgcuggacaaccuggugaugcuccacaccagcgagcacggcgggcgcgccuaccggcacgccauggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucguccuggaguucuucaugauggugcuccugauccccgagcccgagaagcagcgcacgccccaggacaaccagcuggccuacguggucaucgggauccucacccuggccgcgaucaucgccgccaacgagaugggccugcucgagaccaccaagcgggaccugggcauguccaaggagccggggguggugagccccacguccuaccuggacgucgaccuccaccccgccagcgcguggacccuguacgccguggccaccaccgugaucacgcccaugcugcgccacaccaucgagaacuccaccgccaacgucagccucgccgcgaucgccaaccaggccguggugcugaugggccuggacaagggguggccgaucuccaagauggaccucggcgucccccugcuggcccucgggugcuacagccaggugaacccccugacccugacggccgcggugcuccugcugaucacccacuacgccaucaucggccccggccuccaggccaaggccacccgggaggcccagaagcgcaccgcggccgggaucaugaagaacccgacggucgacggcaucaugaccaucgaccuggaccccgugauguacgacuccaaguucgagaagcagcugggccaggugaugcuccugguccugugcgccgugcagcuccugcugaugcggaccagcugggcccucugcgaggcgcugacccuggccacgggccccaucaccacccucugggagggcucccccgggaaguucuggaacaccacgaucgccgugagcauggccaacaucuuccgcggcuccuaccuggccggggcgggccuggccuucagcaucaugaaguccgucgggaccggcaagcggggcaccgggagccagggcgagacccucggggagaaguggaagaagaagcugaaccagcugagccgcaaggaguucgaccucuacaagaaguccggcaucaccgagguggaccggacggaggccaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgcgggccugaagaaggucaccgaggugcgcggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccggaccauccgcguccugaagaugguggagccguggcucaagaacaaccaguucugcaucaaggugcugaaccccuacaugcccacggucaucgagcaccuggagcggcuccagcgcaagcacggcgggaugcuggugcggaacccccugucccgcaacagcacccacgagauguacuggaucuccaacggcaccgggaacaucguggccagcgucaacauggugucccggcuccugcugaaccgcuucaccaugacgcaccggcgcccgaccaucgagaaggacguggaccucggcgccggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggcgaccgggagcgccuccagcaugaucaacggcgucgugaagcugcugaccaagcccugggacgucgugcccauggugacgcagauggccaugaccgacaccacccccuucgggcagcagcgcgucuucaaggagaagguggacacgcggaccccgcgcagcaugcccggcacccggcgcgugaugggcaucaccgccgaguggcucuggcggacgcuggggcgcaacaagaagccccgccugugcacccgggaggaguucaccaagaagguccgcaccaacgcggccaugggcgccguguucacggaggagaaccagugggacuccgccaaggccgcgguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgcgauguacgccgacgacaccgccgggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcgcagcucauccggcagauggagggcgagggggugcugagcaaggccgaccuggagaacccccaccucccggagaagaagaucacccaguggcuggagacgaagggcgucgagcgccugaagcggauggccaucuccggcgacgacugcguggugaagcccaucgacgaccgcuucgccaacgcccuccuggcgcugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccgcaucagccagggggccggcuggucccuccgggagaccgccugccugggcaaggcguacgcccagauguggagccugauguacuuccaccgccgggaccuccgccuggccuccaacgccaucugcagcgccgugcccgugcacugggucccgaccucccggaccacguggagcauccacgcgcaccaccaguggaugaccaccgaggacaugcugaccguguggaaccgcguguggaucgaggacaaccccuggauggaggacaagacgcccgucaccaccugggagaacgugcccuaccucgggaagcgggaggaccaguggugcggcagccugaucgggcugaccucccgcgccacgugggcccagaacaucccgaccgccauccagcagguccggagccucaucggcaacgaggaguuccuggacuacaugcccuccaugaagcgcuuccggaaggaggaggagagcgagggggccaucugguga

SEQ ID NO: 9831 - RNA, 9873 nt, Artificial Sequence
  derived and/or modified CDS sequence (opt1) from DENV-3__JX669494__SS-prME
accagccugugccucaugaugauccugcccgccgcccuggcguuccaccucaccagccgggacggggagccgcggaugaucguggggaagaacgagcgcggcaagagccugcuguucaagaccgccuccgggaccaacaugugcacccucaucgccauggaccugggggagaugugcgacgacaccgugaccuacaagugcccccacaucaccgagguggagcccgaggacaucgacugcuggugcaaccugaccagcaccugggugacguacgggaccugcaaccaggccggcgagcggcgccgggacaagcgcuccguggcccucgcgccccacgugggcauggggcuggacacccggacccagacguggaugagcgccgagggcgccuggcgccagguggagaagguggagaccugggcccugcggcacccgggguucaccauccucgcgcuguuccuggcccacuacaucggcaccucccucacgcagaagguggugaucuucauccugcugaugcucgugacccccagcaugaccaugcgcugcgugggggugggcaaccgggacuucgucgagggccuguccggggccaccuggguggacgugguccuggagcacggcgggugcgugacgaccauggccaagaacaagcccacccucgacaucgagcugcagaagaccgaggccacgcagcuggcgacccuccgcaagcugugcaucgagggcaagaucaccaacaucaccacggacagccggugccccacccagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggcgauccugcccgaguacggcacccuggggcucgagugcuccccgcggacgggccuggacuucaacgagaugauccugcucaccaugaagaacaaggccuggauggugcaccgccagugguucuucgaccugccccugcccuggaccagcggcgccaccacggagacccccaccuggaaccggaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccgccugaagauggacaagcucgagcugaagggcaugagcuacgccaugugcacgaacaccuucguccugaagaaggagguguccgagacccagcacgggaccauccucaucaagguggaguaccggggcgaggacgcgccgugcaagauccccuucagcacggaggacgggcagggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccgcauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcggcucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccggccgggcuaccacacccagacggccgggcccuggcaccucggcaagcuggagcuggacuucaacuacugcgagggcaccaccguggucaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccuggucuccgccggcagcgggaagguggacaacuucaccaugggcgugcugugccucgcgauccuguucgaggaggucaugcgggggaaguucggcaagaagcacaugaucgccggggugcuguucaccuucgugcuccugcuguccggccagaucaccuggcgcgacauggcccacacgcucaucaugaucggcagcaacgccuccgaccggauggggaugggcgucaccuaccuggcccugaucgcgaccuucaagauccagcccuuccucgcccugggguucuuccugcgcaagcucaccagccgggagaaccugcugcucggcgugggccuggccauggccacgacccugcagcuccccgaggacaucgagcagauggcgaacgggaucgcccugggccugauggcccucaagcugaucacccaguucgagaccuaccagcuguggacggcccucaucagccugaccugcuccaacaccauguucacccugacgguggccuggcgcaccgcgacccucauccuggccggggucagccugcucccggugugccaguccagcuccaugcgcaagaccgacuggcugcccauggccgucgccgccaugggcgugccgccccugccccuguucaucuucagccugaaggacacgcugaagcggcgcuccuggccccucaacgagggggugauggcggucggccuggugagcauccuggccuccagccuccugcggaacgacgugcccauggccggcccccuggucgccgggggccuccugaucgccugcuacgugaucaccgggaccuccgcggaccugaccguggagaaggccgccgacaucacgugggaggaggaggccgagcagaccggcgucagccacaaccucaugaucaccguggacgacgacgggaccaugcgcaucaaggacgacgagaccgagaacauccugacggugcugcucaagaccgcccugcugaucgucuccggcguguucccguacagcauccccgcgacccuccugguguggcacaccuggcagaagcagacgcagcgguccggcguccugugggacgugcccagcccgcccgagacccagaaggccgagcucgaggaggggguguaccgcaucaagcagcagggcaucuucgggaagacccaggucggcgugggggugcagaaggagggcgucuuccacaccauguggcacgugacgcggggcgccgugcugaccuacaacgggaagcgccuggagcccaacugggccuccgucaagaaggaccucaucagcuacggcgggggcuggcggcuguccgcgcaguggcagaagggggaggagguccaggugaucgccgucgagcccggcaagaaccccaagaacuuccagaccaugcccggcaccuuccagacgaccaccggggagaucggcgccaucgcccuggacuucaagcccgggaccagcggcagccccaucaucaaccgcgagggcaaggugguggggcuguacggcaacggggucgugacgaagaacggcggguacguguccggcaucgcccagaccaacgcggagccggacggccccacccccgagcucgaggaggagauguucaagaagcggaaccugaccaucauggaccugcaccccgggagcggcaagacgcgcaaguaccucccggccaucguccgggaggccaucaagcgccggcugcgcacccugauccucgcccccacccgggugguggccgcggagauggaggaggcccugaaggggcugcccauccgcuaccagaccacggccaccaaguccgagcacaccggccgggagaucgucgaccucaugugccacgccaccuucacgaugcgccugcugagccccgugcgggugccgaacuacaaccucaucaucauggacgaggcccacuucaccgaccccgcguccaucgccgcccgcggguacaucagcacccgcgucggcaugggcgaggccgcggccaucuucaugaccgccacgccgcccgggaccgccgacgccuucccgcaguccaacgcgcccauccaggacgaggagcgggacauccccgagcgcagcuggaacuccggcaacgaguggaucaccgacuucgccgggaagaccgugugguucgugcccagcaucaaggccggcaacgacaucgccaacugccugcggaagaacgggaagaaggucauccagcugucccgcaagacguucgacaccgaguaccagaagaccaagcucaacgacugggacuucguggugaccacggacaucagcgagaugggcgccaacuucaaggcggaccgggucaucgacccgcgccggugccugaagcccgugauccugaccgacggccccgagcgcgugauccucgccgggcccaugccggucaccgccgccuccgccgcgcagcggcgcggccggguggggcgcaacccccagaaggagaacgaccaguacaucuucaccggccagccccugaacaacgacgaggaccacgcccacuggaccgaggccaagaugcugcucgacaacaucaacacgcccgaggggaucaucccggcccuguucgagcccgagcgggagaaguccgcggccaucgacggcgaguaccgccugaagggcgagucccggaagaccuucguggagcucaugcgccgcggggaccugcccgucuggcuggcccacaagguggccagcgagggcaucaaguacaccgaccgcaaguggugcuucgacgggcagcggaacaaccagauccucgaggagaacauggacgucgagaucuggaccaaggagggcgagaagaagaagcugcgcccccgcuggcuggacgcccggacguacuccgacccgcucgcgcugaaggaguucaaggacuucgccgccggccgcaagagcaucgcccuggaccucgugaccgagaucgggcgggugcccucccaccuggcccaccgcacccggaacgcgcuggacaaccucgucaugcugcacaccagcgagcacggcgggcgcgccuaccggcacgccguggaggagcugcccgagacgauggagacccuccugcugcucggccugaugauccugcucaccgggggcgccaugcuguuccugaucagcggcaaggggaucggcaagaccuccaucgggcucaucugcgugaucgccagcuccggcaugcuguggauggcggagaucccgcugcaguggaucgccagcgccaucguccucgaguucuucaugauggugcugcugauccccgagcccgagaagcagcgcacgccccaggacaaccagcucgccuacguggucaucgggauccugacccuggccgcgaucaucgccgccaacgagaugggccuccuggagaccaccaagcgggaccugggcauguccaaggagccggggguggugagccccacguccuaccucgacgucgaccugcaccccgccagcgcguggacccuguacgccguggccaccaccgugaucacgcccaugcuccgccacaccaucgagaacuccaccgccaacgucagccuggccgcgaucgccaaccaggccguggugcugaugggccucgacaagggguggccgaucuccaagauggaccugggcgucccccugcucgcccuggggugcuacagccaggugaacccccugacccucacggccgcggugcugcugcucaucacccacuacgccaucaucggccccggccugcaggccaaggccacccgggaggcccagaagcgcaccgcggccgggaucaugaagaacccgacggucgacggcaucaugaccaucgaccuggaccccgugaucuacgacuccaaguucgagaagcagcucggccaggugaugcugcugguccucugcgccgugcagcugcugcucaugcggaccagcugggcccugugcgaggcgcugacccucgccacgggccccaucaccacccugugggagggcucccccgggaaguucuggaacaccacgaucgccgugagcauggccaacaucuuccgcggcuccuaccuggccggggcgggccucgccuucagcaucaugaaguccgucgggaccggcaagcggggcaccgggagccagggcgagacccugggggagaaguggaagaagaagcugaaccagcucagccgcaaggaguucgaccuguacaagaaguccggcaucaccgagguggaccggacggaggccaaggaggggcugaagcgcggcgagaucacccaccacgccgugagccggggcuccgccaagcuccagugguucgucgagcgcaacauggugaucccggaggggcgggugaucgaccugggcugcgggcgcggcggguggagcuacuacugcgcgggccugaagaaggucaccgaggugcgcggcuacaccaagggcgggcccgggcacgaggagcccgugcccauguccacguacggcuggaacaucgucaagcucaugagcgggaaggacguguucuaccugccgcccgagaagugcgacacccugcugugcgacaucggcgaguccagccccucccccaccguggaggagagccggaccauccgcguccucaagaugguggagccguggcugaagaacaaccaguucugcaucaaggugcugaaccccuacaugcccacggucaucgagcaccucgagcggcugcagcgcaagcacggcgggaugcuggugcggaacccccucucccgcaacagcacccacgagauguacuggaucuccaacggcaccgggaacaucguggccagcgucaacaccgugucccggcugcugcucaaccgcuucacgaugacccaccggcgcccgaccaccgagaaggacguggaccugggcgccggcacgcggcacgucaacgccgagcccgagacccccaacauggacgugaucggggagcgcaucaagcggaucaaggaggagcacaacagcaccuggcacuacgacgacgagaacccguacaagaccugggccuaccacggcuccuacgaggugaaggcgacggggagcgccuccagcaugaucaacggcgucgugaagcugcucaccaagcccugggacgucgugcccauggugacccagauggccaugaccgacacgacccccuucgggcagcagcgcgucuucaaggagaagguggacacccggaccccgcgcagcaugcccggcacgcggcgcgugaugggcaucaccgccgaguggcuguggcggacccuggggcgcaacaagaagccccgccucugcacccgggaggaguucacgaagaagguccgcaccaacgcggccaugggcgccguguucaccgaggagaaccagugggacuccgccaaggccgcgguggaggacgaggacuucuggaagcuggucgaccgggagcgcgagcugcacaagcucgggaagugcggcagcugcguguacaacaugauggggaagcgggagaagaagcugggcgaguucggcaaggccaaggggucccgcgccaucugguacauguggcugggcgcccgguaccucgaguucgaggcccugggguuccugaacgaggaccacugguucagccgcgagaacuccuacagcggcguggagggggagggccuccacaagcugggcuacauccugcgggacaucuccaagauccccgggggcgcgauguacgccgacgacaccgccgggugggacacgcgcaucaccgaggacgaccuccacaacgaggagaagaucacccagcagauggacccggagcaccggcagcuggccaacgccaucuucaagcugaccuaccagaacaaggucgugaaggugcagcgccccacccccacgggcaccgucauggacaucaucagccggaaggaccagcgcggcuccggccaggugggcaccuacgggcucaacaccuucacgaacauggaggcgcagcugauccggcagauggagggcgagggggugcugagcaaggccgaccucgagaacccccaccucccggagaagaagaucacccaguggcuggagaccaagggcgucgagcgccucaagcggauggccaucuccggcgacgacugcguggugaagcccaucgacgaccgcuucgccaacgcccugcuggcgcucaacgacauggggaagguccggaaggacaucccccaguggcagcccagcaagggcuggcacgacuggcagcaggucccguucugcucccaccacuuccacgagcugaucaugaaggacgggcgcaagcuggugguccccugccggccccaggacgagcucaucggccgcgcccgcaucagccagggggccggcuggucccugcgggagaccgccugccugggcaaggcguacgcccagauguggagccucauguacuuccaccgccgggaccugcgccuggccuccaacgccaucugcagcgccgugcccgugcacugggucccgacgucccggaccaccuggagcauccacgcgcaccaccaguggaugaccacggaggacaugcucaccguguggaaccgcguguggaucgaggacaaccccuggauggaggacaagacccccgucaccacgugggagaacgugcccuaccuggggaagcgggaggaccaguggugcggcagccugaucgggcucaccucccgcgccaccugggcccagaacaucccgaccgccauccagcagguccggagccugaucggcaacgaggaguuccuggacuacaugcccuccaugaagcgcuuccggaaggaggaggagagcgagggggccaucugguga

SEQ ID NO: 9832 - RNA, 9873 nt, Artificial Sequence
  derived and/or modified CDS sequence (opt1) from DENV-3__JX669503__SS-prME
accagcuucugccugaugaugauccuccccgcggcccuggcguuccaccugaccagccgggacggggagccgcggaugaucguggggaagaacgagcgcggcaagagccuccuguucaagaccgccuccgggaucaacaugugcacccugaucgccauggaccucggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccuggcgccccacgugggcauggggcucgacacccggacccagaccuggaugagcgccgagggcgccuggcgccagguggagaagguggagacgugggcccugcggcacccgggguucaccauccuggcccucuuccuggcccacuacaucggcaccucccugacccagaagguggugaucuucauccuccugaugcuggucacgcccagcaugaccaugcgcugcgugggggugggcaaccgggacuucgucgagggccucuccggggccaccuggguggacgugguccuggagcacggcgggugcgugaccacgauggccaagaacaagcccacccuggacaucgagcuccagaagaccgaggccacccagcuggcgacgcugcgcaagcucugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccuguucgggaagggcucccucgugaccugcgccaaguuccagugccuggagcccaucgagggcaaggucgugcaguacgagaaccugaaguacaccgugaucaucacgguccacaccggggaccagcaccaggugggcaacgagacccagggggucaccgccgagaucacgccccaggccagcaccaccgaggcgauccuccccgaguacggcacccuggggcuggagugcuccccgcggaccggccucgacuucaacgagaugauccugcugacgaugaagaacaaggccuggauggugcaccgccagugguucuucgaccucccccugcccuggaccagcggcgccaccaccgagacgcccaccuggaaccggaaggagcugcucgugaccuucaagaacgcccacgccaagaagcaggaggucguggugcuggggucccaggagggcgcgaugcacaccgcccugacgggggccaccgagauccagaacagcggcgggaccuccaucuucgccggccaccucaagugccgccugaagauggacaagcuggagcucaagggcaugagcuacgccaugugcaccaacacguucguccugaagaaggagguguccgagacccagcacgggaccauccugaucaagguggaguacaagggcgaggacgcgccgugcaagauccccuucagcaccgaggacgggcagggcaaggcccacaacggccggcucaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccgcggcgcccggcgcauggccauccugggcgacaccgcgugggacuucggguccgugggcggggugcugaacagccucggcaagaugguccaccagaucuucggguccgccuacacggcccuguucagcggcguguccugggugaugaagaucggcaucgggguccugcucaccuggaucggccugaacagcaagaacaccuccaugagcuucuccugcaucgccaucgggaucaucacccuguaccucggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccuggccaccgccaucgccggcgcgugggagaacggggucugcggcauccggagcacgacccgcauggagaaccuccuguggaagcagaucgccaacgagcugaacuacauccucugggagaacaacaucaagcugaccgugguggucggggacaucaucggcgugcuggagcagggcaagcggacccucacgccccagccgauggagcugaaguacuccuggaagaccugggggaaggccaagaucgugaccgccgagacccagaacagcuccuucaucaucgacggccccaacacgcccgagugccccagcgcgucccgcgccuggaacgucugggagguggaggacuacggguucggcguguucaccaccaacaucuggcugaagcuccgggaggucuacacccagcugugcgaccaccgccugaugagcgccgccgugaaggacgagcgggccgugcacgcggacaugggcuacuggaucgagagccagaagaacggguccuggaagcucgagaaggccagccugaucgaggucaagaccugcacguggccgaagucccacacccuguggagcaacggcgugcucgaguccgacaugaucauccccaagagccuggccgggcccaucucccagcacaaccaccgcccgggcuaccacacccagaccgccgggcccuggcaccugggcaagcucgagcuggacuucaacuacugcgagggcacgaccguggucaucaccgagaacugcgggacccggggccccagccugcgcacgaccaccguguccgggaagcucauccacgaguggugcugccggagcugcacccugcccccgcugcgcuacaugggcgaggacgggugcugguacggcauggagauccggcccaucuccgagaaggaggagaacauggucaagagccucgucuccgccggcagcgggaagguggacaacuucacgaugggcgugcugugccuggcgauccucuucgaggaggucaugcgcgggaaguucggcaagaagcacaugaucgccgggguguucuucaccuucgugcugcugcucuccggccagaucaccuggcgggacauggcccacacccugaucaugaucggcagcaacgccuccgaccgcauggggaugggcgucacguaccuggcccucaucgcgaccuucaagauccagcccuuccuggcccugggguucuuccuccggaagcugaccagccgcgagaaccugcuccugggcgugggccuggccauggccaccacgcuccagcugcccgaggacaucgagcagauggcgaacgggaucgcccugggccucauggcccugaagcugaucacccaguucgagaccuaccagcucuggaccgcccugaucagccugacgugcuccaacaccauguucacccucaccguggccuggcggacggcgacccugauccuggccggggucagccuccugccggugugccaguccagcuccaugcgcaagaccgacuggcugcccauggccgucgccgccaugggcgugccgccccucccgcuguucaucuucagccugaaggacacccucaagcgccgguccuggccccugaacgagggggugauggcggucggccuggugagcauccucgccuccagccugcugcgcaacgacgugcccauggccggcccccucgucgccgggggccugcugaucgccugcuacgugaucacggggaccuccgcggaccucaccguggagaaggccgccgacaucaccugggaggaggaggccgagcagacgggcgucagccacaaccugaugaucaccguggacgacgacgggaccaugcggaucaaggacgacgagaccgagaacauccugaccgugcuccugaagacggcccugcucaucgucuccggcguguucccguacagcauccccgcgacccugcugguguggcacaccuggcagaagcagacccagcgcuccggcguccucugggacgugcccagcccgcccgagacgcagaaggccgagcuggaggaggggguguaccggaucaagcagcagggcaucuucgggaagacccaggucggcgugggggugcagaaggagggcgucuuccacaccauguggcacgugacccgcggcgccgugcugacguacaacgggaagcggcucgagcccaacugggccuccgucaagaaggaccugaucagcuacggcgggggcuggcgccuguccgcgcaguggcagaagggggaggagguccaggugaucgccgucgagcccggcaagaaccccaagaacuuccagaccaugcccggcaccuuccagaccacgaccggggagaucggcgccaucgcccucgacuucaagcccgggaccagcggcagccccaucaucaaccgggagggcaaggugguggggcuguacggcaacggggucgugaccaagaacggcggguacguguccggcaucgcccagacgaacgcggagccggacggccccacccccgagcuggaggaggagauguucaagaagcgcaaccugaccaucauggaccuccaccccgggagcggcaagacccggaaguaccugccggccaucguccgcgaggccaucaagcggcgccugcggacgcucauccuggcccccacccgcgugguggccgcggagauggaggaggcccugaaggggcuccccauccgguaccagaccaccgccacgaaguccgagcacaccggccgcgagaucgucgaccugaugugccacgccaccuucaccaugcggcugcucagccccgugcgcgugccgaacuacaaccugaucaucauggacgaggcccacuucacggaccccgcguccaucgccgcccggggguacaucagcacccgcgucggcaugggcgaggccgcggccaucuucaugaccgccacgccgcccgggacggccgacgccuucccgcaguccaacgcgcccauccaggacgaggagcgcgacauccccgagcggagcuggaacuccggcaacgaguggaucaccgacuucgccgggaagaccgugugguucgugcccagcaucaaggccggcaacgacaucgccaacugccugcgcaagaacgggaagaaggucauccagcucucccggaagaccuucgacacggaguaccagaagaccaagcugaacgacugggacuucguggugaccaccgacaucagcgagaugggcgccaacuucaaggcggaccgcgucaucgacccgcggcgcugccugaagcccgugauccucacggacggccccgagcgggugguccuggccgggcccaugccggugaccgccgccuccgccgcgcagcgccggggccgcguggggcggaacccccagaaggagaacgaccaguacaucuucaccggccagccccugaacaacgacgaggaccacgcccacuggaccgaggccaagaugcuccuggacaacaucaacacccccgaggggaucaucccggcccuguucgagcccgagcgcgagaaguccgcggccaucgacggcgaguaccggcucaagggcgagucccgcaagacguucgucgagcugaugcggcgcggggaccugcccguguggcucgcccacaaggucgccagcgagggcaucaaguacaccgaccggaaguggugcuucgacgggcagcgcaacaaccagauccuggaggagaacauggacguggagaucuggaccaaggagggcgagaagaagaagcugcggccccgcuggcucgacgcccgcaccuacuccgacccgcuggcgcugaaggaguucaaggacuucgccgccggccgcaagagcaucgcccucgaccuggugacggagaucgggcgcguccccucccaccuggcccaccggacccgcaacgcgcucgacaaccuggugaugcugcacaccagcgagcacggcgggcgggccuaccgccacgccguggaggagcuccccgagaccauggagacgcugcugcuccugggccugaugauccuccugaccgggggcgccaugcuguuccucaucagcggcaaggggaucggcaagaccuccaucgggcugaucugcgucaucgccagcuccggcaugcuguggauggcggagaucccgcuccaguggaucgccagcgccaucgugcuggaguucuucaugauggugcugcucauccccgagcccgagaagcagcggacgccccaggacaaccagcuggccuacgucgugaucgggauccugacgcucgccgcgaucaucgccgccaacgagaugggccugcuggagaccaccaagcgcgaccucggcauguccaaggagccggggguggucagccccaccuccuaccuggacguggaccugcaccccgccagcgcguggacgcucuacgccguggccaccaccgucaucacccccaugcugcggcacacgaucgagaacuccaccgccaacgugagccuggccgcgaucgccaaccaggccgugguccucaugggccuggacaagggguggccgaucuccaagauggaccugggcgugccccuccuggcccuggggugcuacagccaggugaacccccucacccugaccgccgcgguccugcuccugaucacgcacuacgccaucaucggccccggccugcaggccaaggccacccgcgaggcccagaagcggaccgcggccgggaucaugaagaacccgaccguggacggcaucaugacgaucgaccucgaccccgugaucuacgacuccaaguucgagaagcagcuggggcaggucaugcugcucgugcugugcgccgugcagcugcuccugaugcgcaccagcugggcccugugcgaggcgcucacccuggccaccggccccaucacgacccugugggagggcucccccgggaaguucuggaacaccaccaucgccgucagcauggccaacaucuuccggggcuccuaccucgccggggcgggccuggccuucagcaucaugaaguccguggggacgggcaagcgcggcaccgggagccagggcgagacccugggggagaaguggaagaagaagcucaaccagcugagccggaaggaguucgaccuguacaagaaguccggcaucaccgagguggaccgcaccgaggccaaggaggggcucaagcggggcgagaucacgcaccacgccgucagccgcggcuccgccaagcugcagugguucguggagcggaacauggugaucccggaggggcgcgucaucgaccugggcugcgggcggggcggguggagcuacuacugcgcgggccucaagaaggugaccgaggugcgcggcuacaccaagggcgggcccgggcacgaggagcccguccccauguccaccuacggcuggaacaucgugaagcugaugagcgggaaggacguguucuaccugccgcccgagaagugcgacacgcuccugugcgacaucggcgaguccagccccucccccaccgucgaggagagccgcaccauccgggugcugaagaugguggagccguggcugaagaacaaccaguucugcaucaagguccucaaccccuacaugcccaccgugaucgagcaccuggagcgccugcagcggaagcacggcgggaugcucgugcgcaacccccugucccggaacagcacgcacgagauguacuggaucuccaacggcaccgggaacaucgucgccagcgugaacauggugucccgccugcuccugaaccgguucaccaugacccaccgccggccgacgaucgagaaggacgucgaccugggcgccggcacccgccacgugaacgccgagcccgagacccccaacauggacgugaucggggagcggaucaagcgcaucaaggaggagcacaacagcaccuggcacuacgacgacgagaacccguacaagacgugggccuaccacggcuccuacgaggucaaggcgaccgggagcgccuccagcaugaucaacggcguggucaagcuccugaccaagcccugggacguggugcccauggucacccagauggccaugacggacaccacccccuucgggcagcagcggguguucaaggagaagguggacacccgcacgccgcggagcaugcccggcacccgccgggucaugggcaucaccgccgaguggcuguggcgcacccucgggcggaacaagaagccccgccugugcacgcgcgaggaguucaccaagaaggugcggaccaacgcggccaugggcgccguguucaccgaggagaaccagugggacuccgccaaggccgcggucgaggacgaggacuucuggaagcugguggaccgcgagcgggagcuccacaagcuggggaagugcggcagcugcguguacaacaugauggggaagcgcgagaagaagcugggcgaguucggcaaggccaaggggucccgggccaucugguacauguggcucggcgcccgcuaccuggaguucgaggcccugggguuccucaacgaggaccacugguucagccgggagaacuccuacagcggcgucgagggggagggccugcacaagcugggcuacauccuccgcgacaucuccaagauccccgggggcgcgauguacgccgacgacacggccgggugggacacccggaucaccgaggacgaccugcacaacgaggagaagaucacccagcagauggacccggagcaccgccagcuggccaacgccaucuucaagcucacguaccagaacaagguggugaagguccagcggcccacccccaccggcaccgugauggacaucaucagccgcaaggaccagcggggcuccggccaggugggcaccuacgggcugaacacguucaccaacauggaggcgcagcugauccgccagauggagggcgaggggguccucagcaaggccgaccuggagaacccccaccuccccgagaagaagaucacccaguggcuggagaccaagggcguggagcggcugaagcgcauggccaucuccggcgacgacugcguggucaagcccaucgacgaccgguucgccaacgcccugcucgcgcugaacgacauggggaaggugcgcaaggacaucccccaguggcagcccagcaagggcuggcacgacuggcagcaggucccguucugcucccaccacuuccacgagcugaucaugaaggacgggcggaagcucgucgugcccugccgcccccaggacgagcugaucggccgggcccgcaucagccagggggccggcuggucccugcgcgagacggccugccucggcaaggcguacgcccagauguggagccugauguacuuccaccggcgcgaccugcggcucgccuccaacgccaucugcagcgccgugcccguccacugggugccgaccucccgcaccaccuggagcauccacgcgcaccaccaguggaugacgaccgaggacaugcugaccguguggaaccgggucuggaucgaggacaaccccuggauggaggacaagacccccgugacgaccugggagaacgugcccuaccuggggaagcgcgaggaccaguggugcggcagccucaucgggcugaccucccgggccaccugggcccagaacaucccgacggccauccagcagguccgcagccugaucggcaacgaggaguuccucgacuacaugcccuccaugaagcgguuccgcaaggaggaggagagcgagggggccaucugguga

SEQ ID NO: 9833 - RNA, 9873 nt, Artificial Sequence
  derived and/or modified CDS sequence (opt1) from DENV-3__JX669493__SS-prME
accagcuucugccugaugaugauccuccccgcggcccuggcguuccaccugaccagccgggacggggagccgcggaugaucguggggaagaacgagcgcggcaagagccuccuguucaagaccgccuccgggaucaacaugugcacccugaucgccauggaccucggggagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccuggcgccccacgugggcauggggcucgacacccggacccagaccuggaugagcgccgagggcgccuggcgccagguggagaagguggagacgugggcccugcggcacccgggguucaccauccuggcccucuuccuggcccacuacaucggcaccucccugacccagaagguggugaucuucauccuccugaugcuggugacgcccagcaugaccaugcgcugcgugggggugggcaaccgggacuucgucgagggccucuccggggccaccuggguggacgugguccuggagcacggcgggugcgugaccacgauggccaagaacaagcccacccuggacaucgagcuccagaagaccgaggccacccagcuggcgacgcugcgcaagcucugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccuguucgggaagggcucccucgugaccugcgccaaguuccagugccuggagcccaucgagggcaaggucgugcaguacgagaaccugaaguacaccgugaucaucacgguccacaccggggaccagcaccaggugggcaacgagacccagggggucaccgccgagaucacgccccaggccagcaccaccgaggcgauccuccccgaguacggcacccuggggcuggagugcuccccgcggaccggccucgacuucaacgagaugauccugcugacgaugaagaacaaggccuggauggugcaccgccagugguucuucgaccucccccugcccuggaccagcggcgccaccaccgagacgcccaccuggaaccggaaggagcugcucgugaccuucaagaacgcccacgccaagaagcaggaggucguggugcuggggucccaggagggcgcgaugcacaccgcccugacgggggccaccgagauccagaacagcggcgggaccuccaucuucgccggccaccucaagugccgccugaagauggacaagcuggagcucaagggcaugagcuacgccaugugcaccaacacguucguccugaagaaggagguguccgagacccagcacgggaccauccugaucaagguggaguacaagggcgaggacgcgccgugcaagauccccuucagcaccgaggacgggcagggcaaggcccacaacggccggcucaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccgcggcgcccggcgcauggccauccugggcgacaccgcgugggacuucggguccgugggcggggugcugaacagccucggcaagaugguccaccagaucuucggguccgccuacacggcccuguucagcggcguguccugggugaugaagaucggcaucgggguccugcucaccuggaucggccugaacagcaagaacaccuccaugagcuucuccugcaucgccaucgggaucaucacccuguaccucggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccuggccaccgccaucgccggcgcgugggagaacggggucugcggcauccggagcacgacccgcauggagaaccuccuguggaagcagaucgccaacgagcugaacuacauccucugggagaacaacaucaagcugaccgugguggucggggacaucaucggcgugcuggagcagggcaagcggacccucacgccccagccgauggagcugaaguacuccuggaagaccugggggaaggccaagaucgugaccgccgagacccagaacagcuccuucaucaucgacggccccaacacgcccgagugccccagcgcgucccgcgccuggaacgucugggagguggaggacuacggguucggcguguucaccaccaacaucuggcugaagcuccgggaggucuacacccagcugugcgaccaccgccugaugagcgccgccgugaaggacgagcgggccgugcacgcggacaugggcuacuggaucgagagccagaagaacggguccuggaagcucgagaaggccagccugaucgaggucaagaccugcacguggccgaagucccacacccuguggagcaacggcgugcucgaguccgacaugaucauccccaagagccuggccgggcccaucucccagcacaaccaccgcccgggcuaccacacccagaccgccgggcccuggcaccugggcaagcucgagcuggacuucaacuacugcgagggcacgaccguggucaucaccgagaacugcgggacccggggccccagccugcgcacgaccaccguguccgggaagcucauccacgaguggugcugccggagcugcacccugcccccgcugcgcuacaucggcgaggacgggugcugguacggcauggagauccggcccaucuccgagaaggaggagaacauggucaagagccucgucuccgccggcagcgggaagguggacaacuucacgaugggcgugcugugccuggcgauccucuucgaggaggucaugcgcgggaaguucggcaagaagcacaugaucgccgggguguucuucaccuucgugcugcugcucuccggccagaucaccuggcgggacauggcccacacccugaucaugaucggcagcaacgccuccgaccgcauggggaugggcgucacguaccuggcccucaucgcgaccuucaagauccagcccuuccuggcccugggguucuuccuccggaagcugaccagccgcgagaaccugcuccugggcgugggccuggccauggccaccacgcuccagcugcccgaggacaucgagcagauggcgaacgggaucgcccugggccucauggcccugaagcugaucacccaguucgagaccuaccagcucuggaccgcccugaucagccugacgugcuccaacaccauguucacccucaccguggccuggcggacggcgacccugauccuggccggggucagccuccugccggugugccaguccagcuccaugcgcaagaccgacuggcugcccauggccgucgccgccaugggcgugccgccccucccgcuguucaucuucagccugaaggacacccucaagcgccgguccuggccccugaacgagggggugauggcggucggccuggugagcauccucgccuccagccugcugcgcaacgacgugcccauggccggcccccucgucgccgggggccugcugaucgccugcuacgugaucacggggaccuccgcggaccucaccguggagaaggccgccgacaucaccugggaggaggaggccgagcagacgggcgucagccacaaccugaugaucaccguggacgacgacgggaccaugcggaucaaggacgacgagaccgagaacauccugaccgugcuccugaagacggcccugcucaucgucuccggcguguucccguacagcauccccgcgacccugcugguguggcacaccuggcagaagcagacccagcgcuccggcguccucugggacgugcccagcccgcccgagacgcagaaggccgagcuggaggaggggguguaccggaucaagcagcagggcaucuucgggaagacccaggucggcgugggggugcagaaggagggcgucuuccacaccauguggcacgugacccgcggcgccgugcugacguacaacgggaagcggcucgagcccaacugggccuccgucaagaaggaccugaucagcuacggcgggggcuggcgccuguccgcgcaguggcagaagggggaggagguccaggugaucgccgucgagcccggcaagaaccccaagaacuuccagaccaugcccggcaccuuccagaccacgaccggggagaucggcgccaucgcccucgacuucaagcccgggaccagcggcagccccaucaucaaccgggagggcaaggugguggggcuguacggcaacggggucgugaccaagaacggcggguacguguccggcaucgcccagacgaacgcggagccggacggccccacccccgagcuggaggaggagauguucaagaagcgcaaccugaccaucauggaccuccaccccgggagcggcaagacccggaaguaccugccggccaucguccgcgaggccaucaagcggcgccugcggacgcucauccuggcccccacccgcgugguggccgcggagauggaggaggcccugaaggggcuccccauccgguaccagaccaccgccacgaaguccgagcacaccggccgcgagaucgucgaccugaugugccacgccaccuucaccaugcggcugcucagccccgugcgcgugccgaacuacaaccugaucaucauggacgaggcccacuucacggaccccgcguccaucgccgcccggggguacaucagcacccgcgucggcaugggcgaggccgcggccaucuucaugaccgccacgccgcccgggacggccgacgccuucccgcaguccaacgcgcccauccaggacgaggagcgcgacauccccgagcggagcuggaacuccggcaacgaguggaucaccgacuucgccgggaagaccgugugguucgugcccagcaucaaggccggcaacgacaucgccaacugccugcgcaagaacgggaagaaggucauccagcucucccggaagaccuucgacacggaguaccagaagaccaagcugaacgacugggacuucguggugaccaccgacaucagcgagaugggcgccaacuucaaggcggaccgcgucaucgacccgcggcgcugccugaagcccgugauccucacggacggccccgagcgggugauccuggccgggcccaugccggucaccgccgccuccgccgcgcagcgccggggccgcguggggcggaacccccagaaggagaacgaccaguacaucuucaccggccagccccugaacaacgacgaggaccacgcccacuggaccgaggccaagaugcuccuggacaacaucaacacccccgaggggaucaucccggcccuguucgagcccgagcgcgagaaguccgcggccaucgacggcgaguaccggcucaagggcgagucccgcaagacguucguggagcugaugcggcgcggggaccugcccgucuggcucgcccacaagguggccagcgagggcaucaaguacaccgaccggaaguggugcuucgacgggcagcgcaacaaccagauccuggaggagaacauggacgucgagaucuggaccaaggagggcgagaagaagaagcugcggccccgcuggcucgacgcccgcaccuacuccgacccgcuggcgcugaaggaguucaaggacuucgccgccggccgcaagagcaucgcccucgaccuggugacggagaucgggcgcgugcccucccaccuggcccaccggacccgcaacgcgcucgacaaccuggucaugcugcacaccagcgagcacggcgggcgggccuaccgccacgccguggaggagcuccccgagaccauggagacgcugcugcuccugggccugaugauccuccugaccgggggcgccaugcuguuccucaucagcggcaaggggaucggcaagaccuccaucgggcugaucugcgugaucgccagcuccggcaugcuguggauggcggagaucccgcuccaguggaucgccagcgccaucguccuggaguucuucaugauggugcugcucauccccgagcccgagaagcagcggacgccccaggacaaccagcuggccuacguggucaucgggauccugacgcucgccgcgaucaucgccgccaacgagaugggccugcuggagaccaccaagcgcgaccucggcauguccaaggagccggggguggugagccccaccuccuaccuggacgucgaccugcaccccgccagcgcguggacgcucuacgccguggccaccaccgugaucacccccaugcugcggcacacgaucgagaacuccaccgccaacgucagccuggccgcgaucgccaaccaggccguggugcucaugggccuggacaagggguggccgaucuccaagauggaccugggcgucccccuccuggcccuggggugcuacagccaggugaacccccucacccugaccgccgcggugcugcuccugaucacgcacuacgccaucaucggccccggccugcaggccaaggccacccgcgaggcccagaagcggaccgcggccgggaucaugaagaacccgaccgucgacggcaucaugacgaucgaccucgaccccgugaucuacgacuccaaguucgagaagcagcugggccaggugaugcugcucguccugugcgccgugcagcugcuccugaugcgcaccagcugggcccugugcgaggcgcucacccuggccaccggccccaucacgacccugugggagggcucccccgggaaguucuggaacaccaccaucgccgugagcauggccaacaucuuccggggcuccuaccucgccggggcgggccuggccuucagcaucaugaaguccgucgggacgggcaagcgcggcaccgggagccagggcgagacccugggggagaaguggaagaagaagcucaaccagcugagccggaaggaguucgaccuguacaagaaguccggcaucaccgagguggaccgcaccgaggccaaggaggggcucaagcggggcgagaucacgcaccacgccgugagccgcggcuccgccaagcugcagugguucgucgagcggaacauggugaucccggaggggcgcgugaucgaccugggcugcgggcggggcggguggagcuacuacugcgcgggccucaagaaggucaccgaggugcgcggcuacaccaagggcgggcccgggcacgaggagcccgugcccauguccaccuacggcuggaacaucgucaagcugaugagcgggaaggacguguucuaccugccgcccgagaagugcgacacgcuccugugcgacaucggcgaguccagccccucccccaccguggaggagagccgcaccauccggguccugaagaugguggagccguggcugaagaacaaccaguucugcaucaaggugcucaaccccuacaugcccaccgucaucgagcaccuggagcgccugcagcggaagcacggcgggaugcucgugcgcaacccccugucccggaacagcacgcacgagauguacuggaucuccaacggcaccgggaacaucguggccagcgucaacauggugucccgccugcuccugaaccgguucaccaugacccaccgccggccgacgaucgagaaggacguggaccugggcgccggcacccgccacgucaacgccgagcccgagacccccaacauggacgugaucggggagcggaucaagcgcaucaaggaggagcacaacagcaccuggcacuacgacgacgagaacccguacaagacgugggccuaccacggcuccuacgaggugaaggcgaccgggagcgccuccagcaugaucaacggcgucgugaagcuccugaccaagcccugggacgucgugcccauggugacccagauggccaugacggacaccacccccuucgggcagcagcgggucuucaaggagaagguggacacccgcacgccgcggagcaugcccggcacccgccgggugaugggcaucaccgccgaguggcuguggcgcacccucgggcggaacaagaagccccgccugugcacgcgcgaggaguucaccaagaagguccggaccaacgcggccaugggcgccguguucaccgaggagaaccagugggacuccgccaaggccgcgguggaggacgaggacuucuggaagcuggucgaccgcgagcgggagcuccacaagcuggggaagugcggcagcugcguguacaacaugauggggaagcgcgagaagaagcugggcgaguucggcaaggccaaggggucccgggccaucugguacauguggcucggcgcccgcuaccuggaguucgaggcccugggguuccucaacgaggaccacugguucagccgggagaacuccuacagcggcguggagggggagggccugcacaagcugggcuacauccuccgcgacaucuccaagauccccgggggcgcgauguacgccgacgacacggccgggugggacacccggaucaccgaggacgaccugcacaacgaggagaagaucacccagcagauggacccggagcaccgccagcuggccaacgccaucuucaagcucacguaccagaacaaggucgugaaggugcagcggcccacccccaccggcaccgucauggacaucaucagccgcaaggaccagcggggcuccggccaggugggcaccuacgggcugaacacguucaccaacauggaggcgcagcugauccgccagauggagggcgagggggugcucagcaaggccgaccuggagaacccccaccuccccgagaagaagaucacccaguggcuggagaccaagggcgucgagcggcugaagcgcauggccaucuccggcgacgacugcguggugaagcccaucgacgaccgguucgccaacgcccugcucgcgcugaacgacauggggaagguccgcaaggacaucccccaguggcagcccagcaagggcuggcacgacuggcagcaggucccguucugcucccaccacuuccacgagcugaucaugaaggacgggcggaagcucgugguccccugccgcccccaggacgagcugaucggccgggcccgcaucagccagggggccggcuggucccugcgcgagacggccugccucggcaaggcguacgcccagauguggagccugauguacuuccaccggcgcgaccugcggcucgccuccaacgccaucugcagcgccgugcccgugcacugggucccgaccucccgcaccaccuggagcauccacgcgcaccaccaguggaugacgaccgaggacaugcugaccguguggaaccggguguggaucgaggacaaccccuggauggaggacaagacccccgucacgaccugggagaacgugcccuaccuggggaagcgcgaggaccaguggugcggcagccucaucgggcugaccucccgggccaccugggcccagaacaucccgacggccauccagcagguccgcagccugaucggcaacgaggaguuccucgacuacaugcccuccaugaagcgguuccgcaaggaggaggagagcgagggggccaucugguga

SEQ ID NO: 9834 - RNA, 9873 nt, Artificial Sequence
  derived and/or modified CDS sequence (opt1) from DENV-3__JX669504__SS-prME
accagccugugccucaugaugauccugcccgccgcccuggcguuccaccucaccagccgggacggggagccgcggaugaucguggggaagaacgagcgcggcaagagccugcuguucaagaccgccuccgggaccaacaugugcacccucaucgccauggaccugggggagaugugcgacgacaccgugaccuacaagugcccccacaucaccgagguggagcccgaggacaucgacugcuggugcaaccugaccagcaccugggugacguacgggaccugcaaccaggccggcgagcggcgccgggacaagcgcuccguggcccucgcgccccacgugggcauggggcuggacacccggacccagacguggaugagcgccgagggcgccuggcgccagguggagaagguggagaccugggcccugcggcacccgggguucaccauccucgcgcuguuccuggcccacuacaucggcaccucccucacgcagaagguggugaucuucauccugcugaugcucgugacccccagcaugaccaugcgcugcgugggggugggcaaccgggacuucgucgagggccuguccggggccaccuggguggacgugguccuggagcacggcgggugcgugacgaccauggccaagaacaagcccacccucgacaucgagcugcagaagaccgaggccacgcagcuggcgacccuccgcaagcugugcaucgagggcaagaucaccaacaucaccacggacagccggugccccacccagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggcgauccugcccgaguacggcacccuggggcucgagugcuccccgcggacgggccuggacuucaacgagaugauccugcucaccaugaagaacaaggccuggauggugcaccgccagugguucuucgaccugccccugcccuggaccagcggcgccaccacggagacccccaccuggaaccggaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccgccugaagauggacaagcucgagcugaagggcaugagcuacgccaugugcacgaacaccuucguccugaagaaggagguguccgagacccagcacgggaccauccucaucaagguggaguaccggggcgaggacgcgccgugcaagauccccuucagcacggaggacgggcagggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccgcauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcggcucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccggccgggcuaccacacccagacggccgggcccuggcaccucggcaagcuggagcuggacuucaacuacugcgagggcaccaccguggucaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccuggucuccgccggcagcgggaagguggacaacuucaccaugggcgugcugugccucgcgauccuguucgaggaggucaugcgggggaaguucggcaagaagcacaugaucgccgggguguucuucacccuggugcuccugcuguccggccagaucaccuggcgcgacauggcccacacgcucaucaugaucggcagcaacgccuccgaccggauggggaugggcgucaccuaccuggcccugaucgcgaccuucaagauccagcccuuccucgcccugggguucuuccugcgcaagcucaccagccgggagaaccugcugcucggcgugggccuggccauggccacgacccugcagcuccccgaggacaucgagcagauggcgaacgggaucgcccugggccugauggcccucaagcugaucacccaguucgagaccuaccagcuguggacggcccucaucagccugaccugcuccaacaccauguucacccugacgguggccuggcgcaccgcgacccucauccuggccggggucagccugcucccggugugccaguccagcuccaugcgcaagaccgacuggcugcccauggccgucgccgccaugggcgugccgccccugccccuguucaucuucagccugaaggacacgcugaagcggcgcuccuggccccucaacgagggggugauggcggucggccuggugagcauccuggccuccagccuccugcggaacgacgugcccauggccggcccccuggucgccgggggccuccugaucgccugcuacgugaucaccgggaccuccgcggaccugaccguggagaaggccgccgacaucacgugggaggaggaggccgagcagaccggcgucagccacaaccucaugaucaccguggacgacgacgggaccaugcgcaucaaggacgacgagaccgagaacauccugacggugcugcucaagaccgcccugcugaucgucuccggcguguucccguacagcauccccgcgacccuccugguguggcacaccuggcagaagcagacgcagcgguccggcguccugugggacgugcccagcccgcccgagacccagaaggccgagcucgaggaggggguguaccgcaucaagcagcagggcaucuucgggaagacccaggucggcgugggggugcagaaggagggcgucuuccacaccauguggcacgugacgcggggcgccgugcugaccuacaacgggaagcgccuggagcccaacugggccuccgucaagaaggaccucaucagcuacggcgggggcuggcggcuguccgcgcaguggcagaagggggaggagguccaggugaucgccgucgagcccggcaagaaccccaagaacuuccagaccaugcccggcaccuuccagacgaccaccggggagaucggcgccaucgcccuggacuucaagcccgggaccagcggcagccccaucaucaaccgcgagggcaaggugguggggcuguacggcaacggggucgugacgaagaacggcggguacguguccggcaucgcccagaccaacgcggagccggacggccccacccccgagcucgaggaggagauguucaagaagcggaaccugaccaucauggaccugcaccccgggagcggcaagacgcgcaaguaccucccggccaucguccgggaggccaucaagcgccggcugcgcacccugauccucgcccccacccgggugguggccgcggagauggaggaggcccugaaggggcugcccauccgcuaccagaccacggccaccaaguccgagcacaccggccgggagaucgucgaccucaugugccacgccaccuucacgaugcgccugcugagccccgugcgggugccgaacuacaaccucaucaucauggacgaggcccacuucaccgaccccgcguccaucgccgcccgcggguacaucagcacccgcgucggcaugggcgaggccgcggccaucuucaugaccgccacgccgcccgggaccgccgacgccuucccgcaguccaacgcgcccauccaggacgaggagcgggacauccccgagcgcagcuggaacuccggcaacgaguggaucaccgacuucgccgggaagaccgugugguucgugcccagcaucaaggccggcaacgacaucgccaacugccugcggaagaacgggaagaaggucauccagcugucccgcaagacguucgacaccgaguaccagaagaccaagcucaacgacugggacuucguggugaccacggacaucagcgagaugggcgccaacuucaaggcggaccgggucaucgacccgcgccggugccugaagcccgugauccugaccgacggccccgagcgcgugauccucgccgggcccaugccggucaccgccgccuccgccgcgcagcggcgcggccggguggggcgcaacccccagaaggagaacgaccaguacaucuucaccggccagccccugaacaacgacgaggaccacgcccacuggaccgaggccaagaugcugcucgacaacaucaacacgcccgaggggaucaucccggcccuguucgagcccgagcgggagaaguccgcggccaucgacggcgaguaccgccugaagggcgagucccggaagaccuucguggagcucaugcgccgcggggaccugcccgucuggcuggcccacaagguggccagcgagggcaucaaguacaccgaccgcaaguggugcuucgacgggcagcggaacaaccagauccucgaggagaacauggacgucgagaucuggaccaaggagggcgagaagaagaagcugcgcccccgcuggcuggacgcccggacguacuccgacccgcucgcgcugaaggaguucaaggacuucgccgccggccgcaagagcaucgcccuggaccucgugaccgagaucgggcgggugcccucccaccuggcccaccgcacccggaacgcgcuggacaaccucgucaugcugcacaccagcgagcacggcgggcgcgccuaccggcacgccguggaggagcugcccgagacgauggagacccuccugcugcucggccugaugauccugcucaccgggggcgccaugcuguuccugaucagcggcaaggggaucggcaagaccuccaucgggcucaucugcgugaucgccagcuccggcaugcuguggauggcggagaucccgcugcaguggaucgccagcgccaucguccucgaguucuucaugauggugcugcugauccccgagcccgagaagcagcgcacgccccaggacaaccagcucgccuacguggucaucgggauccugacccuggccgcgaucaucgccgccaacgagaugggccuccuggagaccaccaagcgggaccugggcauguccaaggagccggggguggugagccccacguccuaccucgacgucgaccugcaccccgccagcgcguggacccuguacgccguggccaccaccgugaucacgcccaugcuccgccacaccaucgagaacuccaccgccaacgucagccuggccgcgaucgccaaccaggccguggugcugaugggccucgacaagggguggccgaucuccaagauggaccugggcgucccccugcucgcccuggggugcuacagccaggugaacccccugacccucacggccgcggugcugcugcucaucacccacuacgccaucaucggccccggccugcaggccaaggccacccgggaggcccagaagcgcaccgcggccgggaucaugaagaacccgacggucgacggcaucaugaccaucgaccuggaccccgugaucuacgacuccaaguucgagaagcagcucggccaggugaugcugcugguccucugcgccgugcagcugcugcucaugcggaccagcugggcccugugcgaggcgcugacccucgccacgggccccaucaccacccugugggagggcucccccgggaaguucuggaacaccacgaucgccgugagcauggccaacaucuuccgcggcuccuaccuggccggggcgggccucgccuucagcaucaugaaguccgucgggaccggcaagcggggcaccgggagccagggcgagacccugggggagaaguggaagaagaagcugaaccagcucagccgcaaggaguucgaccuguacaagaaguccggcaucaccgagguggaccggacggaggccaaggaggggcugaagcgcggcgagaucacccaccacgccgugagccggggcuccgccaagcuccagugguucgucgagcgcaacauggugaucccggaggggcgggugaucgaccugggcugcgggcgcggcggguggagcuacuacugcgcgggccugaagaaggucaccgaggugcgcggcuacaccaagggcgggcccgggcacgaggagcccgugcccauguccacguacggcuggaacaucgucaagcucaugagcgggaaggacguguucuaccugccgcccgagaagugcgacacccugcugugcgacaucggcgaguccagccccucccccaccguggaggagagccggaccauccgcguccucaagaugguggagccguggcugaagaacaaccaguucugcaucaaggugcugaaccccuacaugcccacggucaucgagcaccucgagcggcugcagcgcaagcacggcgggaugcuggugcggaacccccucucccgcaacagcacccacgagauguacuggaucuccaacggcaccgggaacaucguggccagcgucaacaccgugucccggcugcugcucaaccgcuucacgaugacccaccggcgcccgaccaccgagaaggacguggaccugggcgccggcacgcggcacgucaacgccgagcccgagacccccaacauggacgugaucggggagcgcaucaagcggaucaaggaggagcacaacagcaccuggcacuacgacgacgagaacccguacaagaccugggccuaccacggcuccuacgaggugaaggcgacggggagcgccuccagcaugaucaacggcgucgugaagcugcucaccaagcccugggacgucgugcccauggugacccagauggccaugaccgacacgacccccuucgggcagcagcgcgucuucaaggagaagguggacacccggaccccgcgcagcaugcccggcacgcggcgcgugaugggcaucaccgccgaguggcuguggcggacccuggggcgcaacaagaagccccgccucugcacccgggaggaguucacgaagaagguccgcaccaacgcggccaugggcgccguguucaccgaggagaaccagugggacuccgccaaggccgcgguggaggacgaggacuucuggaagcuggucgaccgggagcgcgagcugcacaagcucgggaagugcggcagcugcguguacaacaugauggggaagcgggagaagaagcugggcgaguucggcaaggccaaggggucccgcgccaucugguacauguggcugggcgcccgguaccucgaguucgaggcccugggguuccugaacgaggaccacugguucagccgcgagaacuccuacagcggcguggagggggagggccuccacaagcugggcuacauccugcgggacaucuccaagauccccgggggcgcgauguacgccgacgacaccgccgggugggacacgcgcaucaccgaggacgaccuccacaacgaggagaagaucacccagcagauggacccggagcaccggcagcuggccaacgccaucuucaagcugaccuaccagaacaaggucgugaaggugcagcgccccacccccacgggcaccgucauggacaucaucagccggaaggaccagcgcggcuccggccaggugggcaccuacgggcucaacaccuucacgaacauggaggcgcagcugauccggcagauggagggcgagggggugcugagcaaggccgaccucgagaacccccaccucccggagaagaagaucacccaguggcuggagaccaagggcgucgagcgccucaagcggauggccaucuccggcgacgacugcguggugaagcccaucgacgaccgcuucgccaacgcccugcuggcgcucaacgacauggggaagguccggaaggacaucccccaguggcagcccagcaagggcuggcacgacuggcagcaggucccguucugcucccaccacuuccacgagcugaucaugaaggacgggcgcaagcuggugguccccugccggccccaggacgagcucaucggccgcgcccgcaucagccagggggccggcuggucccugcgggagaccgccugccugggcaaggcguacgcccagauguggagccucauguacuuccaccgccgggaccugcgccuggccuccaacgccaucugcagcgccgugcccgugcacugggucccgacgucccggaccaccuggagcauccacgcgcaccaccaguggaugaccacggaggacaugcucaccguguggaaccgcguguggaucgaggacaaccccuggauggaggacaagacccccgucaccacgugggagaacgugcccuaccuggggaagcgggaggaccaguggugcggcagccugaucgggcucaccucccgcgccaccugggcccagaacaucccgaccgccauccagcagguccggagccugaucggcaacgaggaguuccuggacuacaugcccuccaugaagcgcuuccggaaggaggaggagagcgagggggccaucugguga

SEQ ID NO: 9835 - RNA, 9873 nt, Artificial Sequence
  derived and/or modified CDS sequence (opt1) from DENV-3__JX669506__SS-prME
accagcuucugccugaugaugauccuccccgcggcccuggcguuccaccugaccagccgggacggggagccgcggaugaucguggggaagaacgagcgcggcaagagccuccuguucaagaccgccuccgggaucaacaugugcacccugaucgccauggaccucggggagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccuggcgccccacgugggcauggggcucgacacccggacccagaccuggaugagcgccgagggcgccuggcgccagguggagaagguggagacgugggcccugcggcacccgggguucaccauccuggcccucuuccuggcccacuacaucggcaccucccugacccagaagguggugaucuucauccuccugaugcuggugacgcccagcaugaccaugcgcugcgugggggugggcaaccgggacuucgucgagggccucuccggggccaccuggguggacgugguccuggagcacggcgggugcgugaccacgauggccaagaacaagcccacccuggacaucgagcuccagaagaccgaggccacccagcuggcgacgcugcgcaagcucugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccuguucgggaagggcucccucgugaccugcgccaaguuccagugccuggagcccaucgagggcaaggucgugcaguacgagaaccugaaguacaccgugaucaucacgguccacaccggggaccagcaccaggugggcaacgagacccagggggucaccgccgagaucacgccccaggccagcaccaccgaggcgauccuccccgaguacggcacccuggggcuggagugcuccccgcggaccggccucgacuucaacgagaugauccugcugacgaugaagaacaaggccuggauggugcaccgccagugguucuucgaccucccccugcccuggaccagcggcgccaccaccgagacgcccaccuggaaccggaaggagcugcucgugaccuucaagaacgcccacgccaagaagcaggaggucguggugcuggggucccaggagggcgcgaugcacaccgcccugacgggggccaccgagauccagaacagcggcgggaccuccaucuucgccggccaccucaagugccgccugaagauggacaagcuggagcucaagggcaugagcuacgccaugugcaccaacacguucguccugaagaaggagguguccgagacccagcacgggaccauccugaucaagguggaguacaagggcgaggacgcgccgugcaagauccccuucagcaccgaggacgggcagggcaaggccuacaacggccggcucaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccgcggcgcccggcgcauggccauccugggcgacaccgcgugggacuucggguccgugggcggggugcugaacagccucggcaagaugguccaccagaucuucggguccgccuacacggcccuguucagcggcguguccugggugaugaagaucggcaucgggguccugcucaccuggaucggccugaacagcaagaacaccuccaugagcuucuccugcaucgccaucgggaucaucacccuguaccucggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccuggccaccgccaucgccggcgcgugggagaacggggucugcggcauccggagcacgacccgcauggagaaccuccuguggaagcagaucgccaacgagcugaacuacauccucugggagaacaacaucaagcugaccgugguggucggggacaucaucggcgugcuggagcagggcaagcggacccucacgccccagccgauggagcugaaguacuccuggaagaccugggggaaggccaagaucgugaccgccgagacccagaacagcuccuucaucaucgacggccccaacacgcccgagugccccagcgcgucccgcgccuggaacgucugggagguggaggacuacggguucggcguguucaccaccaacaucuggcugaagcuccgggaggucuacacccagcugugcgaccaccgccugaugagcgccgccgugaaggacgagcgggccgugcacgcggacaugggcuacuggaucgagagccagaagaacggguccuggaagcucgagaaggccagccugaucgaggucaagaccugcacguggccgaagucccacacccuguggagcaacggcgugcucgaguccgacaugaucauccccaagagccuggccgggcccaucucccagcacaaccaccgcccgggcuaccacacccagaccgccgggcccuggcaccugggcaagcucgagcuggacuucaacuacugcgagggcacgaccguggucaucaccgagaacugcgggacccggggccccagccugcgcacgaccaccguguccgggaagcucauccacgaguggugcugccggagcugcacccugcccccgcugcgcuacaugggcgaggacgggugcugguacggcauggagauccggcccaucuccgagaaggaggagaacauggucaagagccucgucuccgccggcagcgggaagguggacaacuucacgaugggcgugcugugccuggcgauccucuucgaggaggucaugcgcgggaaguucggcaagaagcacaugaucgccgggguguucuucaccuucgugcugcugcucuccggccagaucaccuggcgggacauggcccacacccugaucaugaucggcagcaacgccuccgaccgcauggggaugggcgucacguaccuggcccucaucgcgaccuucaagauccagcccuuccuggcccugggguucuuccuccggaagcugaccagccgcgagaaccugcuccugggcgugggccuggccauggccaccacgcuccagcugcccgaggacaucgagcagauggcgaacgggaucgcccugggccucauggcccugaagcugaucacccaguucgagaccuaccagcucuggaccgcccugaucagccugacgugcuccaacaccauguucacccucaccguggccuggcggacggcgacccugauccuggccggggucagccuccugccggugugccaguccagcuccaugcgcaagaccgacuggcugcccauggccgucgccgccaugggcgugccgccccucccgcuguucaucuucagccugaaggacacccucaagcgccgguccuggccccugaacgagggggugauggcggucggccuggugagcauccucgccuccagccugcugcgcaacgacgugcccauggccggcccccucgucgccgggggccugcugaucgccugcuacgugaucacggggaccuccgcggaccucaccguggagaaggccgccgacaucaccugggaggaggaggccgagcagacgggcgucagccacaaccugaugaucaccguggacgacgacgggaccaugcggaucaaggacgacgagaccgagaacauccugaccgugcuccugaagacggcccugcucaucgucuccggcguguucccguacagcauccccgcgacccugcugguguggcacaccuggcagaagcagacccagcgcuccggcguccucugggacgugcccagcccgcccgagacgcagaaggccgagcuggaggaggggguguaccggaucaagcagcagggcaucuucgggaagacccaggucggcgugggggugcagaaggagggcgucuuccacaccauguggcacgugacccgcggcgccgugcugacguacaacgggaagcggcucgagcccaacugggccuccgucaagaaggaccugaucagcuacggcgggggcuggcgccuguccgcgcaguggcagaagggggaggagguccaggugaucgccgucgagcccggcaagaaccccaagaacuuccagaccaugcccggcaccuuccagaccacgaccggggagaucggcgccaucgcccucgacuucaagcccgggaccagcggcagccccaucaucaaccgggagggcaaggugguggggcuguacggcaacggggucgugaccaagaacggcggguacguguccggcaucgcccagacgaacgcggagccggacggccccacccccgagcuggaggaggagauguucaagaagcgcaaccugaccaucauggaccuccaccccgggagcggcaagacccggaaguaccugccggccaucguccgcgaggccaucaagcggcgccugcggacgcucauccuggcccccacccgcgugguggccgcggagauggaggaggcccugaaggggcuccccauccgguaccagaccaccgccacgaaguccgagcacaccggccgcgagaucgucgaccugaugugccacgccaccuucaccaugcggcugcucagccccgugcgcgugccgaacuacaaccugaucaucauggacgaggcccacuucacggaccccgcguccaucgccgcccggggguacaucagcacccgcgucggcaugggcgaggccgcggccaucuucaugaccgccacgccgcccgggacggccgacgccuucccgcaguccaacgcgcccauccaggacgaggagcgcgacauccccgagcggagcuggaacuccggcaacgaguggaucaccgacuucgccgggaagaccgugugguucgugcccagcaucaaggccggcaacgacaucgccaacugccugcgcaagaacgggaagaaggucauccagcucucccggaagaccuucgacacggaguaccagaagaccaagcugaacgacugggacuucguggugaccaccgacaucagcgagaugggcgccaacuucaaggcggaccgcgucaucgacccgcggcgcugccugaagcccgugauccucacggacggccccgagcgggugauccuggccgggcccaugccggucaccgccgccuccgccgcgcagcgccggggccgcguggggcggaacccccagaaggagaacgaccaguacaucuucaccggccagccccugaacaacgacgaggaccacgcccacuggaccgaggccaagaugcuccuggacaacaucaacacccccgaggggaucaucccggcccuguucgagcccgagcgcgagaaguccgcggccaucgacggcgaguaccggcucaagggcgagucccgcaagacguucguggagcugaugcggcgcggggaccugcccgucuggcucgcccacaagguggccagcgagggcaucaaguacaccgaccggaaguggugcuucgacgggcagcgcaacaaccagauccuggaggagaacauggacgucgagaucuggaccaaggagggcgagaagaagaagcugcggccccgcuggcucgacgcccgcaccuacuccgacccgcuggcgcugaaggaguucaaggacuucgccgccggccgcaagagcaucgcccucgaccuggugacggagaucgggcgcgugcccucccaccuggcccaccggacccgcaacgcgcucgacaaccuggucaugcugcacaccagcgagcacggcgggcgggccuaccgccacgccguggaggagcuccccgagaccauggagacgcugcugcuccugggccugaugauccuccugaccgggggcgccaugcuguuccucaucagcggcaaggggaucggcaagaccuccaucgggcugaucugcgugaucgccagcuccggcaugcuguggauggcggagaucccgcuccaguggaucgccagcgccaucguccuggaguucuucaugauggugcugcucauccccgagcccgagaagcagcggacgccccaggacaaccagcuggccuacguggucaucgggauccugacgcucgccgcgaucaucgccgccaacgagaugggccugcuggagaccaccaagcgcgaccucggcauguccaaggagccggggguggugagccccaccuccuaccuggacgucgaccugcaccccgccagcgcguggacgcucuacgccguggccaccaccgugaucacccccaugcugcggcacacgaucgagaacuccaccgccaacgucagccuggccgcgaucgccaaccaggccguggugcucaugggccuggacaagggguggccgaucuccaagauggaccugggcgucccccuccuggcccuggggugcuacagccaggugaacccccucacccugaccgccgcggugcugcuccugaucacgcacuacgccaucaucggccccggccugcaggccaaggccacccgcgaggcccagaagcggaccgcggccgggaucaugaagaacccgaccgucgacggcaucaugacgaucgaccucgaccccgugaucuacgacuccaaguucgagaagcagcugggccaggugaugcugcucguccugugcgccgugcagcugcuccugaugcgcaccagcugggcccugugcgaggcgcucacccuggccaccggccccaucacgacccugugggagggcucccccgggaaguucuggaacaccaccaucgccgugagcauggccaacaucuuccggggcuccuaccucgccggggcgggccuggccuucagcaucaugaaguccgucgggacgggcaagcgcggcaccgggagccagggcgagacccugggggagaaguggaagaagaagcucaaccagcugagccggaaggaguucgaccuguacaagaaguccggcaucaccgagguggaccgcaccgaggccaaggaggggcucaagcggggcgagaucacgcaccacgccgugagccgcggcuccgccaagcugcagugguucgucgagcggaacauggugaucccggaggggcgcgugaucgaccugggcugcgggcggggcggguggagcuacuacugcgcgggccucaagaaggucaccgaggugcgcggcuacaccaagggcgggcccgggcacgaggagcccgugcccauguccaccuacggcuggaacaucgucaagcugaugagcgggaaggacguguucuaccugccgcccgagaagugcgacacgcuccugugcgacaucggcgaguccagccccucccccaccguggaggagagccgcaccauccggguccugaagaugguggagccguggcugaagaacaaccaguucugcaucaaggugcucaaccccuacaugcccaccgucaucgagcaccuggagcgccugcagcggaagcacggcgggaugcucgugcgcaacccccugucccggaacagcacgcacgagauguacuggaucuccaacggcaccgggaacaucguggccagcgucaacauggugucccgccugcuccugaaccgguucaccaugacccaccgccggccgacgaucgagaaggacguggaccugggcgccggcacccgccacgucaacgccgagcccgagacccccaacauggacgugaucggggagcggaucaagcgcaucaaggaggagcacaacagcaccuggcacuacgacgacgagaacccguacaagacgugggccuaccacggcuccuacgaggugaaggcgaccgggagcgccuccagcaugaucaacggcgucgugaagcuccugaccaagcccugggacgucgugcccauggugacccagauggccaugacggacaccacccccuucgggcagcagcgggucuucaaggagaagguggacacccgcacgccgcggagcaugcccggcacccgccgggugaugggcaucaccgccgaguggcuguggcgcacccucgggcggaacaagaagccccgccugugcacgcgcgaggaguucaccaagaagguccggaccaacgcggccaugggcgccguguucaccgaggagaaccagugggacuccgccaaggccgcgguggaggacgaggacuucuggaagcuggucgaccgcgagcgggagcuccacaagcuggggaagugcggcagcugcguguacaacaugauggggaagcgcgagaagaagcugggcgaguucggcaaggccaaggggucccgggccaucugguacauguggcucggcgcccgcuaccuggaguucgaggcccugggguuccucaacgaggaccacugguucagccgggagaacuccuacagcggcguggagggggagggccugcacaagcugggcuacauccuccgcgacaucuccaagauccccgggggcgcgauguacgccgacgacacggccgggugggacacccggaucaccgaggacgaccugcacaacgaggagaagaucacccagcagauggacccggagcaccgccagcuggccaacgccaucuucaagcucacguaccagaacaaggucgugaaggugcagcggcccacccccaccggcaccgucauggacaucaucagccgcaaggaccagcggggcuccggccaggugggcaccuacgggcugaacacguucaccaacauggaggcgcagcugauccgccagauggagggcgagggggugcucagcaaggccgaccuggagaacccccaccuccccgagaagaagaucacccaguggcuggagaccaagggcgucgagcggcugaagcgcauggccaucuccggcgacgacugcguggugaagcccaucgacgaccgguucgccaacgcccugcucgcgcugaacgacauggggaagguccgcaaggacaucccccaguggcagcccagcaagggcuggcacgacuggcagcaggucccguucugcucccaccacuuccacgagcugaucaugaaggacgggcggaagcucgugguccccugccgcccccaggacgagcugaucggccgggcccgcaucagccagggggccggcuggucccugcgcgagacggccugccucggcaaggcguacgcccagauguggagccugauguacuuccaccggcgcgaccugcggcucgccuccaacgccaucugcagcgccgugcccgugcacugggucccgaccucccgcaccaccuggagcauccacgcgcaccaccaguggaugacgaccgaggacaugcugaccguguggaaccggguguggaucgaggacaaccccuggauggaggacaagacccccgucacgaccugggagaacgugcccuaccuggggaagcgcgaggaccaguggugcggcagccucaucgggcugaccucccgggccaccugggcccagaacaucccgacggccauccagcagguccgcagccugaucggcaacgaggaguuccucgacuacaugcccuccaugaagcgguuccgcaaggaggaggagagcgagggggccaucugguga

SEQ ID NO: 9836 - RNA, 9873 nt, Artificial Sequence
  derived and/or modified CDS sequence (opt1) from DENV-3__JX669496__SS-prME
accagccugugccucaugaugauccugcccgccgcccuggcguuccaccucaccagccgggacggggagccgcggaugaucguggggaagaacgagcgcggcaagagccugcuguucaagaccgccuccgggaccaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcggcgccgggacaagcgcuccguggcccucgcgccccacgugggcauggggcuggacacccggacccagacguggaugagcgccgagggcgccuggcgccagguggagaagguggagaccugggcccugcggcacccgggguucaccauccucgcgcuguuccuggcccacuacaucggcaccucccucacgcagaagguggugaucuucauccugcugaugcucgugacccccagcaugaccaugcgcugcgugggggugggcaaccgggacuucgucgagggccuguccggggccaccuggguggacgugguccuggagcacggcgggugcgugacgaccauggccaagaacaagcccacccucgacaucgagcugcagaagaccgaggccacgcagcuggcgacccuccgcaagcugugcaucgagggcaagaucaccaacaucaccacggacagccggugccccacccagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggcgauccugcccgaguacggcacccuggggcucgagugcuccccgcggacgggccuggacuucaacgagaugauccugcucaccaugaagaacaaggccuggauggugcaccgccagugguucuucgaccugccccugcccuggaccagcggcgccaccacggagacccccaccuggaaccggaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccgccugaagauggacaagcucgagcugaagggcaugagcuacgccaugugcgcgaacacguucguccugaagaaggagguguccgagacccagcacgggaccauccucaucaagguggaguaccggggcgaggacgccccgugcaagauccccuucagcaccgaggacgggcagggcaaggcccacaacggccgccugaucacggccaaccccgucgugaccaagaaggaggagcccgugaacaucgaggcggagccgcccuucggggagagcaacaucgucaucggcaucggggacaacgcccugaagaucaacugguacaagaagggcuccagcaucgggaagauguucgaggccaccgcccggggcgcccgccgcauggcgauccugggcgacaccgccugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgcgguggugcaggccgacauggggugcgucaucaacuggaagggcaaggagcugaagugcggcagcgggaucuucgugacgaacgaggugcacaccuggaccgagcaguacaaguuccaggccgacucccccaagcggcucgccaccgccaucgcgggcgccugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgcggagacccagaacagcuccuucaucaucgacggccccaacacgcccgagugccccagcgccucccgggccuggaacgucugggagguggaggacuacggguucggcguguucaccaccaacaucuggcucaagcugcgcgaggucuacacccagcugugcgaccaccggcucaugagcgccgccgugaaggacgagcgcgcggugcacgccgacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgcgggcagcgggaagguggacaacuucacgaugggcgugcugugccucgccauccuguucgaggaggucaugcgggggaaguucggcaagaagcacaugaucgccggggugcuguucaccuucgugcuccugcuguccggccagaucaccuggcgcgacauggcccacacccucaucaugaucggcagcaacgccuccgaccggauggggaugggcgucacguaccuggcgcugaucgccaccuucaagauccagcccuuccucgcccugggguucuuccugcgcaagcucaccagccgggagaaccugcugcucggcgugggccuggccauggcgaccacgcugcagcuccccgaggacaucgagcagauggccaacgggaucgcccugggccugauggcccucaagcugaucacccaguucgagaccuaccagcuguggaccgcccucaucagccugacgugcuccaacaccauguucacccugaccguggcguggcgcacggccacccucauccuggccggggucagccugcucccggugugccaguccagcuccaugcgcaagaccgacuggcugcccauggccgucgccgcgaugggcgugccgccccugccccuguucaucuucagccugaaggacacccugaagcggcgcuccuggccccucaacgagggggugauggccgucggccuggugagcauccuggccuccagccuccugcggaacgacgugcccauggccggcccccuggucgccgggggccuccugaucgcgugcuacgugaucacggggaccuccgccgaccugaccguggagaaggccgccgacaucaccugggaggaggaggccgagcagacgggcgucagccacaaccucaugaucaccguggacgacgacgggaccaugcgcaucaaggacgacgagaccgagaacauccugaccgugcugcucaagacggcgcugcugaucgucuccggcguguucccguacagcauccccgccacccuccugguguggcacaccuggcagaagcagacccagcgguccggcguccugugggacgugcccagcccgcccgagacgcagaaggccgagcucgaggaggggguguaccgcaucaagcagcagggcaucuucgggaagacccaggucggcgugggggugcagaaggagggcgucuuccacaccauguggcacgugacccggggcgccgugcugacguacaacgggaagcgccuggagcccaacugggcguccgucaagaaggaccucaucagcuacggcgggggcuggcggcuguccgcccaguggcagaagggggaggagguccaggugaucgccgucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcgcagacgaacgccgagccggacggccccacccccgagcucgaggaggagauguucaagaagcggaaccugaccaucauggaccugcaccccgggagcggcaagacccgcaaguaccucccggccaucguccgggaggccaucaagcgccggcugcgcacgcugauccucgcccccacccgggugguggcggccgagauggaggaggcccugaaggggcugcccauccgcuaccagaccaccgccacgaaguccgagcacaccggccgggagaucgucgaccucaugugccacgccaccuucaccaugcgccugcugagccccgugcgggugccgaacuacaaccucaucaucauggacgaggcgcacuucacggaccccgccuccaucgccgcccgcggguacaucagcacccgcgucggcaugggcgaggcggccgccaucuucaugaccgccacgccgcccgggacggccgacgcguucccgcaguccaacgcccccauccaggacgaggagcgggacauccccgagcgcagcuggaacuccggcaacgaguggaucaccgacuucgccgggaagaccgugugguucgugcccagcaucaaggccggcaacgacaucgccaacugccugcggaagaacgggaagaaggucauccagcugucccgcaagaccuucgacacggaguaccagaagaccaagcucaacgacugggacuucguggugaccaccgacaucagcgagaugggcgcgaacuucaaggccgaccgggucaucgacccgcgccggugccugaagcccgugauccugacggacggccccgagcgcgugauccucgccgggcccaugccggucaccgccgccuccgcggcccagcggcgcggccggguggggcgcaacccccagaaggagaacgaccaguacaucuucaccggccagccccugaacaacgacgaggaccacgcccacuggaccgaggccaagaugcugcucgacaacaucaacacccccgaggggaucaucccggcgcuguucgagcccgagcgggagaaguccgccgccaucgacggcgaguaccgccugaagggcgagucccggaagacguucguggagcucaugcgccgcggggaccugcccgucuggcuggcccacaagguggccagcgagggcaucaaguacaccgaccgcaaguggugcuucgacgggcagcggaacaaccagauccucgaggagaacauggacgucgagaucuggaccaaggagggcgagaagaagaagcugcgcccccgcuggcuggacgcgcggaccuacuccgacccgcucgcccugaaggaguucaaggacuucgccgccggccgcaagagcaucgcccuggaccucgugacggagaucgggcgggugcccucccaccuggcgcaccgcacccggaacgcccuggacaaccucgucaugcugcacaccagcgagcacggcgggcgcgccuaccggcacgccguggaggagcugcccgagaccauggagacgcuccugcugcucggccugaugauccugcucaccgggggcgccaugcuguuccugaucagcggcaaggggaucggcaagaccuccaucgggcucaucugcgugaucgcgagcuccggcaugcuguggauggccgagaucccgcugcaguggaucgccagcgccaucguccucgaguucuucaugauggugcugcugauccccgagcccgagaagcagcgcacgccccaggacaaccagcucgccuacguggucaucgggauccugacgcuggcggccaucaucgccgccaacgagaugggccuccuggagaccaccaagcgggaccugggcauguccaaggagccggggguggugagccccaccuccuaccucgacgucgaccugcaccccgcgagcgccuggacgcuguacgccguggccaccaccgugaucacccccaugcuccgccacacgaucgagaacuccaccgccaacgucagccuggcggccaucgccaaccaggccguggugcugaugggccucgacaagggguggccgaucuccaagauggaccugggcgucccccugcucgcccuggggugcuacagccaggugaacccccugacccucaccgcggccgugcugcugcucaucacgcacuacgccaucaucggccccggccugcaggccaaggccacccgggaggcgcagaagcgcaccgccgccgggaucaugaagaacccgaccgucgacggcaucaugacgaucgaccuggaccccgugaucuacgacuccaaguucgagaagcagcucggccaggugaugcugcugguccucugcgccgugcagcugcugcucaugcggaccagcugggcgcugugcgaggcccugacccucgccaccggccccaucacgacccugugggagggcucccccgggaaguucuggaacaccaccaucgccgugagcauggccaacaucuuccgcggcuccuaccuggcgggggccggccucgccuucagcaucaugaaguccgucgggacgggcaagcggggcaccgggagccagggcgagacccugggggagaaguggaagaagaagcugaaccagcucagccgcaaggaguucgaccuguacaagaaguccggcaucaccgagguggaccggaccgaggccaaggaggggcugaagcgcggcgagaucacgcaccacgccgugagccggggcuccgcgaagcuccagugguucgucgagcgcaacauggugaucccggaggggcgggugaucgaccugggcugcgggcgcggcggguggagcuacuacugcgccggccugaagaaggucaccgaggugcgcggcuacaccaagggcgggcccgggcacgaggagcccgugcccauguccaccuacggcuggaacaucgucaagcucaugagcgggaaggacguguucuaccugccgcccgagaagugcgacacgcugcugugcgacaucggcgaguccagccccucccccaccguggaggagagccggaccauccgcguccucaagaugguggagccguggcugaagaacaaccaguucugcaucaaggugcugaaccccuacaugcccaccgucaucgagcaccucgagcggcugcagcgcaagcacggcgggaugcuggugcggaacccccucucccgcaacagcacgcacgagauguacuggaucuccaacggcaccgggaacaucguggccagcgucaacaccgugucccggcugcugcucaaccgcuucaccaugacgcaccggcgcccgaccaccgagaaggacguggaccugggcgccggcacccggcacgucaacgccgagcccgagacgcccaacauggacgugaucggggagcgcaucaagcggaucaaggaggagcacaacagcaccuggcacuacgacgacgagaacccguacaagaccugggcguaccacggcuccuacgaggugaaggccaccgggagcgccuccagcaugaucaacggcgucgugaagcugcucacgaagcccugggacgucgugcccauggugacccagauggccaugaccgacaccacgcccuucgggcagcagcgcgucuucaaggagaagguggacacccggaccccgcgcagcaugcccggcacccggcgcgugaugggcaucacggcggaguggcuguggcggacccuggggcgcaacaagaagccccgccucugcacccgggaggaguucaccaagaagguccgcacgaacgccgccaugggcgccguguucaccgaggagaaccagugggacuccgccaaggcggccguggaggacgaggacuucuggaagcuggucgaccgggagcgcgagcugcacaagcucgggaagugcggcagcugcguguacaacaugauggggaagcgggagaagaagcugggcgaguucggcaaggccaaggggucccgcgccaucugguacauguggcugggcgcccgguaccucgaguucgaggcgcugggguuccugaacgaggaccacugguucagccgcgagaacuccuacagcggcguggagggggagggccuccacaagcugggcuacauccugcgggacaucuccaagauccccgggggcgccauguacgccgacgacaccgccgggugggacacccgcaucacggaggacgaccuccacaacgaggagaagaucacccagcagauggacccggagcaccggcagcuggccaacgcgaucuucaagcugaccuaccagaacaaggucgugaaggugcagcgccccacccccaccggcacggucauggacaucaucagccggaaggaccagcgcggcuccggccaggugggcaccuacgggcucaacaccuucaccaacauggaggcccagcugauccggcagauggagggcgagggggugcugagcaaggccgaccucgagaacccccaccucccggagaagaagaucacgcaguggcuggagaccaagggcgucgagcgccucaagcggauggccaucuccggcgacgacugcguggugaagcccaucgacgaccgcuucgccaacgcgcugcuggcccucaacgacauggggaagguccggaaggacaucccccaguggcagcccagcaagggcuggcacgacuggcagcaggucccguucugcucccaccacuuccacgagcugaucaugaaggacgggcgcaagcuggugguccccugccggccccaggacgagcucaucggccgcgcccgcaucagccagggggccggcuggucccugcgggagaccgcgugccugggcaaggccuacgcccagauguggagccucauguacuuccaccgccgggaccugcgccuggccuccaacgccaucugcagcgcggugcccgugcacugggucccgaccucccggacgaccuggagcauccacgcccaccaccaguggaugaccaccgaggacaugcucacgguguggaaccgcguguggaucgaggacaaccccuggauggaggacaagacccccgucaccaccugggagaacgugcccuaccuggggaagcgggaggaccaguggugcggcagccugaucgggcucacgucccgcgccaccugggcccagaacaucccgaccgccauccagcagguccggagccugaucggcaacgaggaguuccuggacuacaugcccuccaugaagcgcuuccggaaggaggaggagagcgagggggcgaucugguga

SEQ ID NO: 9837 - RNA, 9873 nt, Artificial Sequence
  derived and/or modified CDS sequence (opt1) from DENV-3__JX669490__SS-prME
accagccugugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggugaucuucauccugcugaugcucgugacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucguccugaagaaggagguguccgagacccagcacgggaccauccucaucaagguggaguaccggggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcggcucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccauguucacccugaccguggccuggcgcacggcgacccugauccucgccggggucagccugcugccggugugccaguccagcuccaugcgcaagaccgacuggcuccccauggccgucgccgccaugggcgugccgccccucccgcuguucaucuucagccucaaggacacccugaagcggcgcuccuggccccugaacgagggggugauggcggucggccucgugagcauccuggccuccagccugcuccggaacgacgugcccauggccggcccccuggucgccgggggccugcucaucgccugcuacgugaucacggggaccuccgcggaccugaccguggagaaggccgccgacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcguguucccguacagcauccccgcgacccugcucguguggcacaccuggcagaagcagacccagcgguccggcguccugugggacgugcccagcccgcccgagacgcagaaggccgagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccuccgucaagaaggaccugaucagcuacggcgggggcuggcggcucuccgcgcaguggcagaagggggaggagguccaggugaucgccgucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgcggagccggacggccccacccccgagcuggaggaggagauguucaagaagcggaaccucaccaucauggaccugcaccccgggagcggcaagacccgcaaguaccugccggccaucguccgggaggccaucaagcgccggcuccgcacgcugauccuggcccccacccgggugguggccgcggagauggaggaggcccucaaggggcugcccauccgcuaccagaccaccgccacgaaguccgagcacaccggccgggagaucgucgaccugaugugccacgccaccuucaccaugcgccuccugagccccgugcgggugccgaacuacaaccugaucaucauggacgaggcccacuucacggaccccgcguccaucgccgcccgcggguacaucagcacccgcgucggcaugggcgaggccgcggccaucuucaugaccgccacgccgcccgggacggccgacgccuucccgcaguccaacgcgcccauccaggacgaggagcgggacauccccgagcgcagcuggaacuccggcaacgaguggaucaccgacuucgccgggaagaccgugugguucgugcccagcaucaaggccggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggcggaccgggucaucgacccgcgccggugccucaagcccgugauccugacggacggccccgagcgcgugauccuggccgggcccaugccggucaccgccgccuccgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagucccggaagacguucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgcuggcuggacgcccggaccuacuccgacccgcuggcgcucaaggaguucaaggacuucgccgccggccgcaagagcaucgcccuggaccuggugacggagaucgggcgggugcccucccaccucgcccaccgcacccggaacgcgcuggacaaccuggucaugcuccacaccagcgagcacggcgggcgcgccuaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucguccuggaguucuucaugauggugcuccugauccccgagcccgagaagcagcgcacgccccaggacaaccagcuggccuacguggucaucgggauccucacgcuggccgcgaucaucgccgccaacgagaugggccugcucgagaccaccaagcgggaccugggcauguccaaggagccggggguggugagccccaccuccuaccuggacgucgaccuccaccccgccagcgcguggacgcuguacgccguggccaccaccgugaucacccccaugcugcgccacacgaucgagaacuccaccgccaacgucagccucgccgcgaucgccaaccaggccguggugcugaugggccuggacaagggguggccgaucuccaagauggaccucggcgucccccugcuggcccucgggugcuacagccaggugaacccccugacccugaccgccgcggugcuccugcugaucacgcacuacgccaucaucggccccggccuccaggccaaggccacccgggaggcccagaagcgcaccgcggccgggaucaugaagaacccgaccgucgacggcaucaugacgaucgaccuggaccccgugaucuacgacuccaaguucgagaagcagcugggccaggugaugcuccugguccugugcgccgugcagcuccugcugaugcggaccagcugggcccucugcgaggcgcugacccuggccaccggccccaucacgacccucugggagggcucccccgggaaguucuggaacaccaccaucgccgugagcauggccaacaucuuccgcggcuccuaccuggccggggcgggccuggccuucagcaucaugaaguccgucgggacgggcaagcggggcaccgggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagaucacgcaccacgccgugagccggggcuccgccaagcugcagugguucgucgagcgcaacauggugaucccggaggggcgggugaucgaccucggcugcgggcgcggcggguggagcuacuacugcgcgggccugaagaaggucaccgaggugcgcggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccggaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacgcacgagauguacuggaucuccaacggcaccgggaacaucguggccagcgucaacauggugucccggcuccugcugaaccgcuucaccaugacccaccggcgcccgacgaucgagaaggacguggaccucggcgccggcacccggcacgucaacgccgagcccgagacccccaacauggacgugaucggggagcgcaucaagcggaucaaggaggagcacaacagcaccuggcacuacgacgacgagaacccguacaagacgugggccuaccacggcuccuacgaggugaaggcgaccgggagcgccuccagcaugaucaacggcgucgugaagcugcugaccaagcccugggacgucgugcccauggugacccagauggccaugacggacaccacccccuucgggcagcagcgcgucuucaaggagaagguggacacccggacgccgcgcagcaugcccggcacccggcgcgugaugggcaucaccgccgaguggcucuggcggacccuggggcgcaacaagaagccccgccugugcacgcgggaggaguucaccaagaagguccgcaccaacgcggccaugggcgccguguucaccgaggagaaccagugggacuccgccaaggccgcgguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgcgauguacgccgacgacacggccgggugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucagccggaaggaccagcgcggcuccggccaggugggcaccuacgggcugaacacguucaccaacauggaggcgcagcucauccggcagauggagggcgagggggugcugagcaaggccgaccuggagaacccccaccucccggagaagaagaucacccaguggcuggagaccaagggcgucgagcgccugaagcggauggccaucuccggcgacgacugcguggugaagcccaucgacgaccgcuucgccaacgcccuccuggcgcugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccgcaucagccagggggccggcuggucccuccgggagacggccugccugggcaaggcguacgcccagauguggagccugauguacuuccaccgccgggaccuccgccuggccuccaacgccaucugcagcgccgugcccgugcacugggucccgaccucccggaccaccuggagcauccacgcgcaccaccaguggaugacgaccgaggacaugcugaccguguggaaccgcguguggaucgaggacaaccccuggauggaggacaagacccccgucacgaccugggagaacgugcccuaccucgggaagcgggaggaccaguggugcggcagccugaucgggcugaccucccgcgccaccugggcccagaacaucccgacggccauccagcagguccggagccucaucggcaacgaggaguuccuggacuacaugcccuccaugaagcgcuuccggaaggaggaggagagcgagggggccaucugguga

SEQ ID NO: 9838 - RNA, 9873 nt, Artificial Sequence
  derived and/or modified CDS sequence (opt1) from DENV-3__JN406515__SS-prME
accagccugugccucaugaugaugcugcccgccacccuggccuuccaccucaccucccgggacggcgagccccggaugaucguggggaagaacgagcggggcaagagccugcuguucaagaccgccuccgggaucaacaugugcacccucaucgccauggaccugggcgagaugugcgacgacaccgugacguacaagugcccccugaucaccgagguggagcccgaggacaucgacugcuggugcaaccucaccagcaccugggugacguacgggaccugcaaccaggccggcgagcaccggcgcgacaagcgguccguggcccuggcgccccacgugggcauggggcuggacacccgcgcgcagaccuggaugagcgccgagggcgccuggcgccagguggagaagguggagacgugggccuuccgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugccggaggagcaggaccagaacuacgucugcaagcacaccuacguggaccggggguggggcaacgggugcggccucuucgggaagggcucccuggugaccugcgccaaguuccagugccuggagcucaucgagggcaaggucgugcagcacgagaaccugaaguacaccgugaucaucacgguccacaccggggaccagcaccaggugggcaacgagacccagggggucaccgccgagaucacgccccaggccagcaccguggaggcgauccugcccgaguacggcacccucgggcuggagugcagcccccggaccggccuggacuucaacgagaugauccuccugaccaugaagaacaaggccuggauggugcaccggcagugguucuucgaccugccgcuccccuggacgagcggcgccaccaccgagacccccacguggaacaagaaggagcugcuggucaccuucaagaacgcccacgccaagaagcaggagguggugguccucgggucccaggagggcgcgaugcacaccgcccugaccggggccacggagauccagaccagcggcgggaccuccaucuucgccggccaccugaagugccgccucaagauggacaagcuggagcugaagggcaugagcuacgccaugugcuccaacgcguucgugcucaagaaggaggugagcgagacccagcacgggacgauccugaucaaggucgaguacaagggcgaggacgcccccugcaagaucccguucagcaccgaggacgagcaggggaaggcccacaacggccggcugaucaccgccaaccccguggugaccaagaaggaggagcccgucaacaucgaggcggagcccccguucggcgaguccaacaucaucaucgggaucggcgacaaggcccugaagaucaacugguacaagaaggggagcuccaucggcaagauguucgaggccacggcccgcggggcccggcgcauggcgauccucggcgacaccgccugggacuucggcagcgucgggggcgugcugaacucccuggggaagaugguccaccagaucuucggcagcgccuacaccgcccucuucuccggggugagcuggaucaugaagaucggcaucggcgugcugcugaccuggaucgggcucaacuccaagaacacgagcauguccuucagcugcaucgucaucggcaucaucacccuguaccugggggccguggugcaggcggacaugggcugcgucaucaacuggaaggggaaggagcucaagugcggcuccggcaucuucgugaccaacgaggugcacaccuggacggagcaguacaaguuccaggccgacagccccaagcggcuggccaccgccaucgccggggcgugggagaacggcgucugcgggauccgcuccaccacccgcauggagaaccugcucuggaagcagaucgccaacgagcugaacuacauccugugggagaacaacaucaagcucacggugguggucggcgacaucaucggggugcuggagcagggcaagcggacccugacgccccagcccauggagcucaaguacagcuggaagaccuggggcaaggccaagaucgugacggccgagacccagaacuccagcuucaucaucgacgggccgaacacccccgagugccccaacgcgucccgcgccuggaacgucugggagguggaggacuacggcuucgggguguucaccacgaacaucuggcugaagcugcgggagauguacacccagcucugcgaccaccgccugaugagcgccgccgucaaggacgagcgggccgugcacgcggacaugggcuacuggaucgagagccagaagaacggcuccuggaagcuggagaaggccagccucaucgaggugaagaccugcaccuggcccaagucccacacccuguggagcaacgggguccuggaguccgacaugaucauccccaagucccucgccggccccaucucccagcacaacuaccgccccggguaccacacgcagaccgccggcccguggcaccuggggaagcuggagcucgacuucaacuacugcgagggcaccaccguggugaucacggagaacugcggcacccgggggcccagccugcgcaccaccacggucuccggcaagcugauccacgaguggugcugccggagcugcacccugccgccccuccgcuacaugggggaggacggcugcugguacgggauggagauccggccgaucaacgagaaggaggagaacauggugaagucccuggugagcgccggcuccggcaaggucgacaacuucaccaugggggugcucugccuggcgauccuguucgaggaggugaugcgcggcaaguucgggaagaagcacaugaucgccggcguccucuucaccuucgugcugcugcucagcgggcagaucacguggcgggacauggcccgcacccugaucaugaucggcuccaacgccagcgaccggaugggcaugggggugaccuaccuggcccucaucgcgaccuucaagauccagcccuuccuggcccugggcuucuuccuccgcaagcugacgucccgggagaaccugcuccugggggucggccuggccauggccaccacccuccagcugcccgaggacguggagcagauggcgaacggcaucgcccuggggcucauggcccugaagcugaucacccaguucgagacguaccagcucuggaccgcccuggugagccugaugugcagcaacaccaucuucacccucacggucgccuggcgcaccgcgacccugauccuggccggcaucucccucuuccccgugugccagagcuccagcaugcggaagaccgacuggcugccgaugacggucgccgccaugggggugccgccccugccccucuucaucuucucccugaaggacacccugaagcgccgcagcuggccgcucaacgagggcgugauggccgucgggcugguguccauccuggcgagcucccuccugcggaacgacgugcccauggccggcccccuggucgccggcgggcuccugaucgccugcuacgugaucaccggcaccagcgccgaccugacgguggagaaggcggccgacgucaccugggaggaggaggccgagcagaccggggugucccacaaccucaugaucaccguggacgacgacggcacgaugcgcaucaaggacgacgagaccgagaacauccugaccguccugcucaagaccgcccugcugaucgugagcgggaucuuccccuacuccaucccggccacccuccugguguggcacacguggcagaagcagacccagcggagcggcguccugugggacgugcccagcccgcccgagacccagaaggcggagcucgaggagggcguguaccgcaucaagcagcaggggaucuucggcaagacccaggucggggugggcgugcagaaggagggggucuuccacacgauguggcacgugacccggggcgccgugcugaccuacaacggcaagcgccuggagccgaacugggccagcgucaagaaggaccucaucuccuacgggggcggguggcggcugagcgcccaguggcagaagggcgaggagguccaggugaucgcggucgagcccgggaagaaccccaagaacuuccagaccaugcccggcaucuuccagacgaccaccggcgagaucggggccaucgcccuggacuucaagccgggcaccuccgggagccccaucaucaaccgcgagggcaagguggugggccuguacgggaacggcgucgugacgaagaacgggggcuacgugagcgggaucgcccagaccaacgccgagcccgacggcccgacccccgagcucgaggaggagauguucaagaagcggaaccugaccaugauggaccugcaccccggcuccgggaagacgcgcaaguaccuccccgcgaucguccgggaggccaucaagcgccggcugcgcacccugauccucgccccgacccgggugguggccgccgagauggaggaggcgcugaagggccugcccauccgcuaccagaccacggccaccaagagcgagcacaccgggaaggagaucgucgaccucaugugccacgccaccuucacgaugcggcugcugucccccgugcgcgugcccaacuacaaccucaucaucauggacgaggcccacuucaccgacccggccagcaucgcggcccggggcuacaucuccacccgcgucgggaugggcgaggccgccgcgaucuucaugaccgccacgccgcccggcaccgccgacgccuucccccagagcaacgccccgauccaggacgaggagcgggacauccccgagcgcuccuggaacagcgggaacgacuggaucaccgacuucgcgggcaagaccgugugguucgugcccuccaucaaggccgggaacgacaucgccaacugccugcgcaagaacggcaagaaggucauccagcugagccggaagacguucgacaccgaguaccagaagaccaagcucaacgacugggacuucguggugaccacggacaucuccgagaugggggccaacuucaaggccgaccgcgucaucgacccccggcgcugccugaagccggugauccugaccgacggccccgagcgggugauccucgcgggccccaugcccgucaccguggccagcgccgcccagcgccgggggcgcgugggccggaacccgcagaaggagaacgaccaguacaucuucaccgggcagccccugaacaacgacgaggaccacgcccacuggacggaggcgaagaugcugcucgacaacaucaacacccccgagggcaucauccccgcccuguucgagccggagcgcgagaaguccgccgccaucgacggggaguaccggcugaagggcgagagccgcaagaccuucgucgagcucaugcggcgcggcgaccugcccguguggcuggcgcacaaggucgccuccgaggggaucaaguacaccgaccggaaguggugcuucgacggcgagcgcaacaaccagauccucgaggagaacauggacguggagaucuggaccaaggagggggagaagaagaagcugcggccccgcuggcuggacgcccggacguacagcgacccccucgcccugaaggaguucaaggacuucgccgcgggccgcaaguccaucgcccuggaccucgugaccgagaucggccgcgucccgagccaccuggcccaccggacccgcaacgcccuggacaaccucgugaugcugcacaccuccgagcacgggggccgggccuaccgccacgcgguggaggagcugcccgagacgauggagacccuccugcugcucgggcugaugauccugcucaccggcggggccaugcuguuccugaucagcggcaagggcgucgggaagaccagcaucggccucaucugcgugguggccuccagcgggaugcuguggauggccgacaucccccugcaguggaucgccuccgcgaucguccucgaguucuucaugauggugcugcugaucccggagcccgagaagcagcggacgccccaggacaaccagcucgccuacguggucaucggcauccugacccuggccgccaucguggccgcgaacgagauggggcuccuggagaccaccaagcgcgaccugggcaugagcaaggagcccggcguggucuccccgacgagcuaccucgacguggaccugcaccccgccuccgccuggacccuguacgccguggcgaccaccgucaucacgcccaugcuccggcacaccaucgagaacagcaccgccaacgugucccuggccgccaucgccaaccaggcggugguccugauggggcucgacaagggcuggcccaucagcaagauggaccugggggugccgcugcucgcccugggcugcuacucccaggugaacccccugacccucacggccgccguccugcugcucgugacccacuacgccaucaucgggcccggccugcaggcgaaggccacccgcgaggcccagaagcggaccgccgccggcaucaugaagaaccccacgguggacgggaucaugaccaucgaccuggacccggucaucuacgacagcaaguucgagaagcagcucggccaggugaugcugcuggugcucugcgcgguccagcugcugcucaugcgcaccuccugggccuucugcgaggcccugacccuggccacggggcccaucaccacccucugggagggcagccccggcaaguucuggaacaccacgaucgcgguguccauggccaacaucuuccgggggagcuaccuggccggcgccgggcuggccuucuccaucaugaaguccgugggcaccgggaagcgcggcaccggcagccagggggagacccucggcgagaaguggaagaagaagcugaaccagcugagccggaaggaguucgaccucuacaagaaguccgggaucacggaggucgaccgcaccgaggcgaaggagggccugaagcgcggggagaucacccaccacgccgugucccgcggcagcgccaagcugcagugguucguggagcggaacauggucauccccgagggccgcgugaucgaccucgggugcggccgcgggggcugguccuacuacugcgccgggcugaagaaggugaccgagguccgcggcuacaccaagggcgggccgggccacgaggagcccgugcccaugagcacguacggguggaacaucgugaagcugauguccggcaaggacgucuucuaccucccgcccgagaagugcgacacccugcugugcgacaucggggagagcucccccagccccaccguggaggagucccggaccauccgcgugcugaagauggucgagcccuggcucaagaacaaccaguucugcaucaaggugcugaaccccuacaugcccacggugaucgagcaccuggagcgccuccagcggaagcacggcggcaugcugguccgcaacccccugagccggaacuccacccacgagauguacuggaucagcaacgggaccggcaacaucguguccagcgugaacauggucucccgccuccugcugaaccgguucaccaugacguaccgccggcccaccaucgagaaggacguggaccucggggccggcacccgccacgucaacgcggagccggagacccccaacauggacgugaucggcgagcggauccgccggaucaaggaggagcacagcuccacguggcacuacgacgacgagaaccccuacaagaccugggccuaccacgggagcuacgaggugaaggccaccggcuccgccagcagcaugaucaacggggucgugaagcugcugaccaagccgugggacgugguccccacggugacccagauggccaugaccgacaccacgcccuucggccagcagcgcguguucaaggagaaggucgacacccggacccccaagccgaugcccgggacccgcaaggugauggagaucacggcggaguggcucuggcggacccugggccgcaacaagcggccccgccugugcacccgggaggaguucaccaagaaggugcgcacgaacgccgccaugggcgccgucuucaccgaggagaaccagugggacuccgcgcgcgccgccguggaggacgaggaguucuggaagcucguggaccgggagcgcgagcugcacaagcuggggaagugcggcagcugcgucuacaacaugauggggaagcgggagaagaagcucggcgaguucgggaaggccaagggcucccgcgccaucugguacauguggcugggcgcgcgguaccuggaguucgaggcccucggguuccugaacgaggaccacugguucagccgcgagaacuccuacagcggcguggagggggagggccugcacaagcucggguacauccugcgggacaucuccaagauccccggcggcgccauguacgccgacgacaccgccgggugggacacccgcaucacggaggacgaccugcacaacgaggagaagaucacccagcagauggacccggagcaccggcagcucgcgaacgccaucuucaagcugaccuaccagaacaagguggucaaggugcagcgccccacccccaagggcacggugauggacaucaucagccggaaggaccagcgcggguccggccaggucggcaccuacgggcugaacaccuucaccaacauggaggcccagcucauccggcagauggagggcgagggggugcugagcaagaccgaccuggagaacccccaccuccuggagaagaagaucacgcaguggcuggagaccaagggcguggagcgccucaagcggauggccaucuccggggacgacugcgucgugaagccgaucgacgaccgcuucgccaacgcgcugcuggcccucaacgacaugggcaaggugcggaaggacaucccccaguggcagcccagcaagggcuggcacgacuggcagcagguccccuucugcucccaccacuuccacgagcugaucaugaaggacgggcgcaagcugguggugccgugccggccccaggacgagcucaucggccgcgcccggaucagccagggggccggcuggucccugaaggagaccgccugccuggggaaggcguacgcccagaugugggcccucauguacuuccaccgccgcgaccugcggcuggccagcaacgcgaucugcuccgccguccccgugcacugggugcccaccagccgcacgaccugguccauccacgcccaccaccaguggaugaccaccgaggacaugcucacggucuggaaccggguguggaucgaggacaacccguggauggaggacaaggcccccgugaccaccugggaggacguccccuaccugggcaagcgcgaggaccaguggugcggcagccugaucgggcucaccagccgggccacgugggcgcagaacauccugaccgccauccagcagguccgcucccugaucggcaacgaggaguuccucgacuacaugcccagcaugaagcgguuccgcaaggaggaggaguccgagggggccaucugguga

SEQ ID NO: 9839 - RNA, 9873 nt, Artificial Sequence
  derived and/or modified CDS sequence (opt1) from DENV-3__JN406514__SS-prME
accagccugugccucaugaugaugcugcccgccacccuggccuuccaccucaccagccgggacggggagccccggaugaucguggggaagaacgagcgcggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguuccuggaccucccccugcccuggacgagcggcgccaccaccgagcgccccaccuggaaccggaaggagcugcucgugacguucaagaacgcccacgccaagaagcaggagguggucgugcuggggucccaggagggcgccaugcacaccgcgcugaccggggccaccgagauccagaacagcggcgggacguccaucuucgccggccaccucaagugccgccugaagauggacaagcuggagcucaagggcaugagcuacgccaugugccugaacaccuucgugcugaagaaggaggucuccgagacccagcacgggaccauccugaucaagguggaguacaagggcgaggacgccccgugcaagauccccuucagcacggaggacgggcagggcaaggcgcacaacggccggcucaucaccgccaaccccguggucaccaagaaggaggagcccgugaacaucgaggccgagccgcccuucggggagagcaacaucgugaucggcaucggggacaaggcccugaagaucaacugguacaagaagggcuccagcaucgggaagauguucgaggcgaccgcccgcggcgcccggcgcauggccauccugggcgacacggccugggacuucggguccgucggcggggugcucaacagccugggcaagauggugcaccagaucuucggguccgcguacaccgcccuguucagcggcgucuccuggaucaugaagaucggcaucggggugcuccugaccuggaucggccugaacagcaagaacaccuccaugagcuucuccugcaucgugaucgggaucaucacgcucuaccugggcgccgucgugcaggccgacauggggugcgugaucaacuggaagggcaaggagcugaagugcggcagcgggaucuucgucaccaacgaggugcacaccuggaccgagcaguacaaguuccaggccgacucccccaagcgccucgcgacggccaucgccggcgccugggagaacggggugugcggcauccggagcaccacccgcauggagaaccugcuguggaagcagaucgccaacgagcucaacuacauccugugggagaacaacaucaagcugaccgucguggugggggacacgaucggcguccucgagcagggcaagcggacccugacgccccagccgauggagcugaaguacuccuggaagaccugggggaaggcgaagaucgugacggccgagacccagaacagcuccuucaucaucgacggccccaacacccccgagugccccagcgccucccgcgccuggaacgugugggaggucgaggacuacggguucggcguguucagcaccaacaucuggcucaagcugcgggagguguacacgcagagcugcgaccaccgccugauguccgcggccaucaaggacgagcgggccguccacgccgacaugggcuacuggaucgagagccagaagaacggguccuggaagcucgagaaggccagcuucaucgaggugaagaccugcaucuggccgaagucccacacccuguggagcaacggcgugcuggaguccgacaugaucauccccaagagccucgcggggcccaucucccagcacaaccaccgcccgggcuaccacacccagaccgccgggcccuggcaccugggcaagcuggagcucgacuucaacuacugcgagggcacgaccgucgugaucaccgagaacugcgggacccggggccccagccugcgcacgaccaccguguccgggaagcugauccacgaguggugcugccggagcugcacccugccgccccugcgcuacaugggcgaggacgggugcugguacggcauggagauccggcccaucaacgagaaggaggagaacauggucaagucccuggugagcgccggcuccgggaagguggacaacuucacgaugggcguccucugccuggccauccuguucgaggaggugaugcgcgggaaguucggcaagaagcacaugaucgccgggguccuguucaccuucguccugcugcucagcggccagaucaccuggcgggacauggcgcacacccugaucaugaucggcuccaacgccagcgaccgcauggggaugggcgugacguaccuggcccucaucgccaccuucaagauccagcccuuccuggcccugggguucuuccuccggaagcugaccagccgcgagaaccugcuccugggcgugggccuggcgauggccaccacgcuccagcugcccgaggacaucgagcagauggccaacgggaucgcccugggccucaugacccugaagcugaucacccaguucgagaccuaccagcucuggacggcgcuggucucccugaccugcagcaacaccaucuucacccucacgguggccuggcggaccgccacccugauccuggccggggucucccuccugccccugugccagagcuccagcaugcgcaagaccgacuggcuccccaugacgguggccgcgaugggcgugccgccccucccgcuguucaucuucucccucaaggacacccccaagcgccggagcuggccccugaacgagggggucauggccgugggccugguguccauccucgccagcucccugcugcgcaacgacguccccauggccggcccgcucguggccgggggccugcugaucgcgugcuacgugaucaccgggaccagcgccgaccucacggucgagaaggccgccgacgugaccugggaggaggaggccgagcagaccggcgugucccacaaccugaugaucaccgucgacgacgacgggacgaugcggaucaaggacgacgagaccgagaacauccugaccgugcuccugaagaccgcgcugcucaucgugagcggcaucuuccccuacuccauccccgccacccugcuggucuggcacacguggcagaagcagacccagcgcagcggcgugcucugggacgugcccuccccgcccgagacccagaaggccgagcuggaggagggggucuaccggaucaagcagcagggcaucuucgggaagacccaggugggcguggggguccagaaggagggcguguuccacacgauguggcacgugacccgcggcgccguccugacccacaacgggaagcggcucgagcccaacugggccagcgugaagaaggaccugaucuccuacggcgggggcuggcgccugagcgcgcaguggcagaagggggaggaggugcaggucaucgccguggagcccggcaagaacccgaagaacuuccagaccaugcccggcaucuuccagacgaccaccggggagaucggcgccaucgcccuggacuucaagcccgggaccagcggcuccccgaucaucaaccgggagggcaagguggucgggcucuacggcaacgggguggugacgaagaacggcggguacgucagcggcaucgcgcagaccaacgccgagcccgacggccccacccccgagcuggaggaggagauguucaagaagcgcaaccugaccaucauggaccuccacccgggguccggcaagacgcggaaguaccugcccgccaucgugcgcgaggccaucaagcggcgccugcggacccucauccuggcccccacccgcguggucgcggccgagauggaggaggcccugaaggggcuccccauccgguaccagaccacggccaccaagagcgagcacaccggccgcgagaucguggaccugaugugccacgccaccuucacgaugcggcugcucuccccggugcgcguccccaacuacaaccugaucaucauggacgaggcgcacuucaccgaccccgccagcaucgccgcccggggguacaucuccacccgcgugggcaugggcgaggccgcggccaucuucaugaccgccacgcccccggggaccgccgaggcguucccccagagcaacgcccccauccaggacgaggagcgcgacauccccgagcgguccuggaacagcggcaacgaguggaucaccgacuucguggggaagaccgucugguucgugccguccaucaaggccggcaacgacaucgccaacugccugcgcaagaacgggaagaaggugauccagcucagccggaagacguucgacaccgaguaccagaagacccgccugaacgacugggacuucgucgugaccacggacaucuccgagaugggcgccaacuucaaggcggaccgggugaucgacccccgccggugccugaagcccgucauccucaccgacggccccgagcgcgugauccuggccgggccgaugcccgugaccgccgccagcgccgcgcagcggcgcggccgggucgggcgcaacccccagaaggagaacgaccaguacaucuucaccggccagccccugaacaacgacgaggaccacgcccacuggacggaggccaagaugcuccuggacaacaucaacaccccggaggggaucauccccgcccuguucgagcccgagcgggagaaguccgccgcgaucgacggcgaguaccgccucaagggcgagagccggaagaccuucguggagcugaugcgccgcggggaccugcccgucuggcucgcccacaagguggccuccgagggcaucaaguacaccgaccgcaaguggugcuucgacggggagcggaacaaccagauccuggaggagaacauggacguggagaucuggaccaaggagggcgagcgcaagaagcugcgcccgcgguggcucgacgcccgcacguacagcgacccccuggcgcugaaggaguucaaggacuucgccgccggccggaaguccaucgcccucgaccuggucaccgagaucgggcgcgugcccagccaccuggcccaccggacccgcaacgcgcucgacaaccuggugaugcugcacaccagcgagcacggcgggcgggccuaccgccacgccgucgaggagcucccggagacgauggagacccugcugcuccugggccugaugauccuccugaccgggggcgccaugcuguuccucaucuccggcaaggggaucggcaagaccagcaucgggcugaucugcgugaucguguccagcggcaugcuguggauggccgacgucccccuccaguggaucgcguccgccaucgugcuggaguucuucaugauggugcugcucauccccgagcccgagaagcagcggacgccgcaggacaaccagcuggccuacgucgugaucgggauccugacccucgccgccaucguggcggccaacgagaugggccugcuggagaccaccaagcgcgaccucggcaugagcaaggagcccggggucgugucccccacgagcuaccuggacguggaccugcaccccgccuccgccuggacccucuacgccgucgcgaccaccgugaucacgccgaugcugcggcacaccaucgagaacagcaccgccaacgugucccuggccgccaucgcgaaccaggccgucgugcucaugggccuggacaagggguggcccaucagcaagauggaccugggcgugccccuccuggcccuggggugcuacucccaggucaacccccucacccugacggccgccgugcugcuccuggugacccacuacgcgaucaucggcccgggccugcaggccaaggccacccgcgaggcccagaagcggaccgccgcggggaucaugaagaaccccacggucgacggcaucaugaccaucgaccucgaccccgugaucuacgacagcaaguucgagaagcagcugggccaggugaugcugcucguccugugcgccgugcagcugcuccugaugcgcaccuccugggcccugugcgaggcccucacccuggccacgggccccaucaccacccugugggagggcagcccggggaaguucuggaacaccacgaucgcgguguccauggccaacaucuuccggggcagcuaccucgccggggccggccuggcguucuccaucaugaaguccgucgggaccggccgccggggcaccgggagccagggcgagacccugggggagaaguggaagaagaagcucaaccagcugucccgcaaggaguucgaccuguacaagaaguccggcaucacggagguggaccggaccgaggccaaggaggggcucaagcgcggcgagaccacccaccacgccgugucccggggcagcgccaagcugcagugguucgucgagcgcaacauggugauccccgaggggcgcgugaucgaccugggcugcgggcggggcgggugguccuacuacugcgccggccucaagaaggucaccgaggugcgcggcuacacgaagggcgggcccgggcacgaggagcccgugccgaugagcaccuacggcuggaacaucgucaagcugauguccgggaaggacguguucuaccugccgcccgagaagugcgacacccugcucugcgacaucggcgagagcucccccagcccgaccguggaggagucccggacgauccgcguccugaagaugguggagcccuggcugaagaacaaccaguucugcaucaaggugcucaaccccuacaugcccaccgucaucgagcaccuggagcggcugcagcgcaaguacggcgggaugcucgugcggaacccgcugagccgcaacuccacccacgagauguacuggaucagcaacggcaccgggaacaucguguccagcgucaacauggugucccggcugcuccugaaccgcuucacgaugacccaccggcgccccaccaucgagaaggacgucgaccugggcgcgggcacccggcacgugaacgccgagcccgagacgccgaacauggacgugaucggggagcgcaucaagcggaucaaggaggagcacagcuccaccuggcacuacgacgacgagaaccccuacaagaccugggccuaccacggcagcuacgaggucaaggccaccgggagcgccuccagcaugaucaacggcguggugaagcuccugacgaagcccugggacgucgugcccauggugacccagauggcgaugaccgacaccacgccguucgggcagcagcgcgucuucaaggagaagguggacacccggacgccccggcccaugcccggcacccggaaggugauggagaucacggccgaguggcuguggcgcacccucggccgcaacaagaagccgcggcugugcacccgcgaggaguucaccaagaagguccggacgaacgccgccaugggggccguguucaccgaggagaaccagugggacuccgcgcgcgccgccguggaggacgaggaguucuggaagcuggucgaccgggagcgcgagcuccacaagcugggcaagugcgggagcugcguguacaacaugaugggcaagcgggagaagaagcugggggaguucggcaaggccaagggcucccgcgcgaucugguacauguggcucggggcccgguaccuggaguucgaggcccugggcuuccucaacgaggaccacugguucagccgcgagaacuccuacagcgggguggagggcgaggggcugcacaagcugggcuacauccuccgggacaucuccaagauccccggcggggccauguacgccgacgacaccgcgggcugggacacccgcaucacggaggacgaccugcacaacgaggagaagaucacccagcagauggaccccgagcacaagcagcuggccaacgccaucuucaagcucaccuaccagaacaaggucgugaaggugcagcggcccaccccgaaggggacggucauggacaucaucagccgcaaggaccagcggggcuccggccagguggggaccuacggccugaacaccuucaccaacauggaggcccagcuggugcgccagauggagggggagggcguccucagcaaggccgaccuggagaacccccaccuccucgagaagaagaucacccaguggcuggagacgaaggggguggagcggcugaagcgcauggcgaucuccggcgacgacugcguggucaagcccaucgacgaccgguucgccaacgcccuccuggcccugaacgacaugggcaaggugcgcaaggacaucccccaguggcagccgagcaagggguggcacgacuggcagcagguccccuucugcucccaccacuuccacgagcucaucaugaaggacggccggaagcuggucgugcccugccgcccccaggacgagcugaucgggcgcgcccggaucagccagggcgcgggguggucccucaaggagaccgccugccugggcaaggccuacgcccagauguggagccugauguacuuccaccgccgggaccuccgccuggccuccaacgcgaucugcagcgccgugccgguccacugggugcccaccagccggaccacgugguccauccacgcccaccaccaguggaugaccaccgaggacaugcugaccguguggaaccgcgucuggaucgaggacaaccccuggauggaggacaagacgcccgugaccaccugggaggacgugccguaccucggcaagcgggaggaccaguggugcgggagccugaucggccugaccucccgcgccacgugggcgcagaacauccucaccgccauccagcagguccggagccugaucggggacgaggaguuccuggacuacaugcccuccaugaagcgcuuccggaaggaggaggagagcgagggcgccaucugguga

SEQ ID NO: 9840 - RNA, 9873 nt, Artificial Sequence
  derived and/or modified CDS sequence (opt1) from DENV-3__KT726340__SS-prME
accagccugugccucaugaugauccugcccgccgcccuggcguuccaccucaccagccgggacggggagccccggaugaucguggggaagaacgagcggggcaagagccugcuguucaagacggccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacggggugaucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucguccgggaggcgaucaagcgccggcuccgcacccugauccuggcccccacccgggugguggccgccgagauggaggaggcccucaaggggcugcccauccgcuaccagaccacggcgaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggguacaucagcacccgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcgggugcccucccaccucgcccaccgcacccggaacgcccuggacaaccuggucaugcuccacaccagcgagcacggcgggaaggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcggacgccccaggacaaccagcuggccuacguggucaucgggauccucacccuggccgccaucaucgccgcgaacgagaugggccugcucgagaccaccaagcgcgaccugggcauguccaaggagccggggguggugagccccacguccuaccuggacgucgaccuccaccccgccagcgccuggacccuguacgccguggcgaccaccgugaucacgcccaugcugcggcacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugacggccgccgugcuccugcugaucacccacuacgccaucaucggccccggccuccaggcgaaggccacccgcgaggcccagaagcggaccgccgccgggaucaugaagaacccgacggucgacggcaucaugaccaucgaccuggaccccgugaucuacgacuccaaguucgagaagcagcugggccaggugaugcuccugguccugugcgcggugcagcuccugcugaugcgcaccagcugggcccucugcgaggcccugacccuggccacgggccccaucaccacccucugggagggcucccccgggaaguucuggaacaccacgaucgcggugagcauggccaacaucuuccggggcuccuaccuggccggggccggccuggccuucagcaucaugaaguccgucgggaccggcaagcgcggcaccgggagccagggcgagacccucggggagaaguggaagaagaagcugaaccagcugagccggaaggaguucgaccucuacaagaaguccggcaucaccgagguggaccgcacggaggcgaaggaggggcugaagcggggcgagaucacccaccacgccgugagccgcggcuccgccaagcugcagugguucgucgagcggaacauggugaucccggaggggcgcgugaucgaccucggcugcgggcggggcggguggagcuacuacugcgccggccugaagaaggucaccgaggugcgcggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccggaccauccgcguccugaagaugguggagccguggcucaagaacaaccaguucugcaucaaggugcugaaccccuacaugcccacggucguggagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucaccaugacgcaccgccggccgaccaucgagaaggacgucgaccucggcgcgggcacccgccacgugaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcggguguucaaggagaagguggacacgcgcaccccgcggagcaugcccggcacccgccgggucaugggcaucaccgccgaguggcucuggcgcacgcuggggcggaacaagaagccccgccugugcacccgggaggaguucaccaagaaggugcgcaccaacgccgccaugggcgcgguguucacggaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucagccgcaaggaccagcggggcuccggccaggugggcacguacgggcugaacaccuucaccaacauggaggcccagcucauccgccagauggagggcgaggggguccugagcaaggccgaccuggagaacccccggcucccggagaagaagaucacccaguggcuggagacgaagggcguggagcgccugaagcggauggcgaucuccggcgacgacugcguggucaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcccggaucagccagggggcgggcuggucccuccgcgagaccgccugccugggcaaggccuacgcccagauguggagccugauguacuuccaccgccgggaccuccgccuggcguccaacgccaucugcagcgccgugcccguccacugggugccgaccucccggaccacguggagcauccacgcccaccaccaguggaugaccaccgaggacaugcugaccguguggaaccgcgucuggaucgaggacaaccccuggauggaggacaagacgcccaucaccaccugggagaacgugcccuaccucgggaagcgggaggaccaguggugcggcagccugaucgggcugaccucccgcgccacgugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 9841 - RNA, 9873 nt, Artificial Sequence
  derived and/or modified CDS sequence (opt1) from DENV-3__KT726345__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucagccucaaggacacccugaagcgccgcuccuggccccugaacgagggggucauggccgugggccucgugagcauccuggcguccagccugcuccggaacgacguccccauggccggcccccugguggccgggggccugcucaucgccugcuacgugaucacggggaccuccgccgaccugaccgucgagaaggcggccgacaucaucugggaggaggaggccgagcagaccggcgugagccacaaccugaugaucacgguggacgacgacgggaccaugcgcaucaaggacgacgagaccgagaacauccucaccguccugcugaagaccgcccuccugaucguguccggcaucuucccguacagcauccccgccacgcugcucguguggcacaccuggcagaagcagacccagcgguccggcguccugugggacgugcccagcccgcccgagacccagaaggcggagcuggaggaggggguguaccgcaucaagcagcagggcaucuucgggaagacgcaggucggcgugggggugcagaaggagggcgucuuccacaccauguggcacgugacccggggcgccgugcucacccacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagacgaugcccggcaccuuccagaccaccacgggggagaucggcgccaucgcccuggacuucaagcccgggaccagcggcagccccaucaucaaccgcgagggcaaggugguggggcuguacggcaacggggucgugaccaagaacggcggguacguguccggcaucgcccagaccaacgccgagccggacggccccacgcccgagcuggaggaggagauguucaagaagcggaaccucaccaucauggaccugcaccccgggagcggcaagacccgcaaguaccugccggcgaucguccgggaggccaucaagcgccggcuccgcacccugauccuggcccccacgcgggugguggccgccgagauggaggaggcgcucaaggggcugcccauccgcuaccagaccaccgccaccaaguccgagcacacgggccgggagaucgucgaccugaugugccacgccaccuucaccaugcgccuccugagccccgugcgggugccgaacuacaaccugaucaucauggacgaggcccacuucaccgaccccgccuccaucgcggcccgcggguacaucagcacgcgggucggcaugggcgaggccgccgcgaucuucaugaccgccacgccgcccgggaccgccgacgccuucccgcaguccaacgcccccauccaggacgaggagcgcgacauccccgagcgcagcuggaacuccggcaacgaguggaucacggacuucgcggggaagaccgugugguucgugcccagcaucaaggccggcaacgacaucgccaacugccuccggaagaacgggaagaaggucauccagcugucccgcaagaccuucgacaccgaguaccagaagacgaagcugaacgacugggacuucguggugaccaccgacaucagcgagaugggcgccaacuucaaggccgaccgggucaucgacccgcgccggugccucaagcccgugauccugaccgacggccccgagcgcgugauccuggcggggcccaugccggucacggccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagaccuucguggagcugaugcgccgcggggaccuccccgucuggcuggcccacaagguggccagcgagggcaucaaguacacggaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggacuucgcggccggccgcaagagcaucgcccuggaccuggugaccgagaucgggcgggugcccucccaccucgcccaccgcacgcggaacgcccuggacaaccuggucaugcuccacaccagcgagcacggcgggcgcgcguaccggcacgccguggaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugcucuggauggccgagaucccgcugcaguggaucgcgagcgccaucguccuggaguucuucaugauggugcuccugauccccgagcccgagaagcagcgcacgccccaggacaaccagcuggccuacguggucaucgggauccucacccuggccgccaucaucgcggccaacgagaugggccugcucgagacgaccaagcgggaccugggcauguccaaggagccggggguggugagccccaccuccuaccuggacgucgaccuccaccccgccagcgccuggacccuguacgcgguggccacgaccgugaucacccccaugcugcgccacaccaucgagaacuccacggccaacgucagccucgccgccaucgcgaaccaggccguggugcugaugggccuggacaagggguggccgaucuccaagauggaccucggcgucccccugcuggcccucgggugcuacagccaggugaacccccugacccugaccgccgccgugcuccugcugaucacccacuacgcgaucaucggccccggccuccaggccaaggccacgcgggaggcccagaagcgcaccgccgcggggaucaugaagaacccgaccgucgacggcaucaugaccaucgaccuggaccccgugaucuacgacuccaaguucgagaagcagcugggccaggugaugcuccugguccugugcgccgugcagcuccugcugaugcggacgagcugggcccucugcgaggcccugacccuggcgaccggccccaucaccacgcucugggagggcucccccgggaaguucuggaacaccaccaucgccgugagcauggccaacaucuuccgcggcuccuaccuggccggggccggccuggcguucagcaucaugaaguccgucgggaccggcaagcggggcacggggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgccggccugaagaaggucacggaggugcggggcuacaccaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccacgguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacccacgagauguacuggaucuccaacggcacggggaacaucguggcgagcgucaacauggugucccggcuccugcugaaccgcuucaccaugacccaccggcgcccgaccaucgagaaggacguggaccucggcgccggcacgcggcacgucaacgccgagcccgagacccccaacauggacgugaucggggagcgcaucaagcggaucaaggaggagcacaacagcaccuggcacuacgacgacgagaacccguacaagaccugggccuaccacggcuccuacgaggugaaggccacggggagcgcguccagcaugaucaacggcgucgugaagcugcugaccaagcccugggacgucgugcccauggugacccagauggccaugaccgacacgacccccuucgggcagcagcgcgucuucaaggagaagguggacacccggaccccgcgcagcaugcccggcacgcggcgcgugaugggcaucaccgccgaguggcucuggcggacccuggggcgcaacaagaagccccggcugugcacccgcgaggaguucacgaagaagguccgcaccaacgccgcgaugggcgccguguucaccgaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgcggacgacaccgccgggugggacacgcgcaucaccgaggacgaccugcacaacgaggagaagaucacccagcagauggacccggagcaccggcagcucgccaacgccaucuucaagcugaccuaccagaacaaggucgugaaggugcagcgccccacgcccaccggcaccgucauggacaucaucagccggaaggaccagcgcggcuccggccaggugggcaccuacgggcugaacaccuucacgaacauggaggcccagcucauccggcagauggagggcgagggggugcugagcaaggcggaccuggagaacccccaccucccggagaagaagaucacccaguggcuggagaccaagggcgucgagcgccugaagcggauggccaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcgcggaucagccagggggccggcuggucccuccgcgagaccgccugccugggcaaggccuacgcgcagauguggagccugauguacuuccaccgccgggaccuccgccuggccuccaacgccaucugcagcgccgugcccgugcacugggucccgacgucccggaccaccuggagcauccacgcccaccaccaguggaugaccacggaggacaugcugaccguguggaaccgcguguggaucgaggacaaccccuggauggaggacaagacccccgucaccacgugggagaacgugcccuaccucgggaagcgggaggaccaguggugcggcagccugaucgggcugaccucccgcgcgaccugggcccagaacaucccgaccgccauccagcagguccggagccucaucggcaacgaggaguuccuggacuacaugcccuccaugaagcgcuuccggaaggaggaggagagcgagggggccaucugguga

SEQ ID NO: 9842 - RNA, 9873 nt, Artificial Sequence
  derived and/or modified CDS sequence (opt1) from DENV-3__KT726349__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucagccucaaggacacccugaagcgccgcuccuggccccugaacgagggggucauggccgugggccucgugagcauccuggcguccagccugcuccggaacgacguccccauggccggcccccugguggccgggggccugcucaucgccugcuacgugaucacggggaccuccgccgaccugaccgucgagaaggcggccgacaucaccugggaggaggaggccgagcagacgggcgugagccacaaccugaugaucaccguggacgacgacgggaccaugcgcaucaaggacgacgagaccgaguccauccucaccguccugcugaagacggcccuccugaucgugagcggcaucuucccguacuccauccccgccacccugcucguguggcacaccuggcagaagcagacccagcggagcggcguccugugggacgugcccagcccgcccgagacgcagaaggcggagcuggaggaggggguguaccgcaucaagcagcagggcaucuucgggaagacccaggucggcgugggggugcagaaggagggcgucuuccacaccauguggcacgugacccggggcgccgugcucacgcacaacgggaagcgccuggagcccaacugggccagcgucaagaaggaccugaucuccuacggcgggggcuggcggcucagcgcccaguggcagaagggggaggagguccaggugaucgcggucgagcccggcaagaaccccaagaacuuccagaccaugcccggcaccuuccagaccacgaccggggagaucggcgccaucgcccuggacuucaagcccgggaccagcggcucccccaucaucaaccgcgagggcaaggugguggggcuguacggcaacggggucgugaccaagaacggcggguacgugagcggcaucgcccagacgaacgccgagccggacggccccacccccgagcuggaggaggagauguucaagaagcggaaccucaccaucauggaccugcaccccggguccggcaagacccgcaaguaccugccggcgaucguccgggaggccaucaagcgccggcuccgcacgcugauccuggcccccacccgggugguggccgccgagauggaggaggcgcucaaggggcugcccauccgcuaccagaccaccgccaccaaguccgagcacaccggccgggagaucgucgaccugaugugccacgccaccuucaccaugcgccuccugucccccgugcgggugccgaacuacaaccugaucaucauggacgaggcccacuucacggaccccgccagcaucgcggcccgcggguacaucuccacccgggucggcaugggcgaggccgccgcgaucuucaugaccgccacgccgcccgggacggccgacgccuucccgcagagcaacgcccccauccaggacgaggagcgcgacauccccgagcgcuccuggaacagcggcaacgaguggaucaccgacuucgcggggaagaccgugugguucgugcccuccaucaaggccggcaacgacaucgccaacugccuccggaagaacgggaagaaggucauccagcugagccgcaagaccuucgacacggaguaccagaagaccaagcugaacgacugggacuucguggugaccaccgacaucuccgagaugggcgccaacuucaaggccgaccgggucaucgacccgcgccggugccucaagcccgugauccugacggacggccccgagcgcgugauccuggcggggcccaugccggucaccgccgccagcgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagagccggaagacguucguggagcugaugcgccgcggggaccuccccgucuggcuggcccacaagguggccuccgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacagcgacccgcuggcccucaaggaguucaaggacuucgcggccggccgcaaguccaucgcccuggaccuggugacggagaucgggcgggugcccagccaccucgcccaccgcacccggaacgcccuggacaaccuggucaugcuccacaccagcgagcacggcgggcgcgcguaccggcacgccguggaggagcugcccgagaccauggagacgcugcuccugcugggccucaugauccugcugaccgggggcgccaugcuguuccugaucuccggcaaggggaucggcaagaccagcaucgggcugaucugcgugaucgccuccagcggcaugcucuggauggccgagaucccgcugcaguggaucgcguccgccaucguccuggaguucuucaugauggugcuccugauccccgagcccgagaagcagcgcacgccccaggacaaccagcuggccuacguggucaucgggauccucacgcuggccgccaucaucgcggccaacgagaugggccugcucgagaccaccaagcgggaccugggcaugagcaaggagccggggguggugucccccaccagcuaccuggacgucgaccuccaccccgccuccgccuggacgcuguacgcgguggccaccaccgugaucacccccaugcugcgccacacgaucgagaacagcaccgccaacgucucccucgccgccaucgcgaaccaggccguggugcugaugggccuggacaagggguggccgaucagcaagauggaccucggcgucccccugcuggcccucgggugcuacucccaggugaacccccugacccugaccgccgccgugcuccugcugaucacgcacuacgcgaucaucggccccggccuccaggccaaggccacccgggaggcccagaagcgcaccgccgcggggaucaugaagaacccgaccgucgacggcaucaugacgaucgaccuggaccccgugaucuacgacagcaaguucgagaagcagcugggccaggugaugcuccugguccugugcgccgugcagcuccugcugaugcggaccuccugggcccucugcgaggcccugacccuggcgaccggccccaucacgacccucugggagggcagccccgggaaguucuggaacaccaccaucgccguguccauggccaacaucuuccgcggcagcuaccuggccggggccggccuggcguucuccaucaugaaguccgucgggacgggcaagcggggcaccgggagccagggcgagacccucggggagaaguggaagaagaagcugaaccagcugucccgcaaggaguucgaccucuacaagaaguccggcaucaccgagguggaccggaccgaggccaaggaggggcugaagcgcggcgagaucacgcaccacgccgugucccggggcagcgccaagcugcagugguucgucgagcgcaacauggugaucccggaggggcgggugaucgaccucggcugcgggcgcggcgggugguccuacuacugcgccggccugaagaaggucaccgaggugcggggcuacaccaagggcgggcccgggcacgaggagcccgugcccaugagcaccuacggcuggaacaucgucaagcugauguccgggaaggacguguucuaccucccgcccgagaagugcgacacgcugcugugcgacaucggcgagagcucccccagccccaccguggaggagucccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugagccgcaacuccacgcacgagauguacuggaucagcaacggcaccgggaacaucguggcguccgucaacauggugagccggcuccugcugaaccgcuucaccaugacccaccggcgcccgacgaucgagaaggacguggaccucggcgccggcacccggcacgucaacgccgagcccgagacccccaacauggacgugaucggggagcgcaucaagcggaucaaggaggagcacaacuccaccuggcacuacgacgacgagaacccguacaagacgugggccuaccacggcagcuacgaggugaaggccaccggguccgcgagcagcaugaucaacggcgucgugaagcugcugaccaagcccugggacgucgugcccauggugacccagauggccaugacggacaccacccccuucgggcagcagcgcgucuucaaggagaagguggacacccggacgccgcgcuccaugcccggcacccggcgcgugaugggcaucaccgccgaguggcucuggcggacccuggggcgcaacaagaagccccggcugugcacgcgcgaggaguucaccaagaagguccgcaccaacgccgcgaugggcgccguguucaccgaggagaaccagugggacagcgccaaggccgccguggaggacgaggacuucuggaagcucgucgaccgggagcgcgagcugcacaagcuggggaagugcggcuccugcguguacaacaugauggggaagcgggagaagaagcucggcgaguucggcaaggcgaaggggagccgcgccaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgccauguacgcggacgacacggccgggugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucucccggaaggaccagcgcggcagcggccaggugggcaccuacgggcugaacacguucaccaacauggaggcccagcucauccggcagauggagggcgagggggugcuguccaaggcggaccuggagaacccccaccucccggagaagaagaucacccaguggcuggagaccaagggcgucgagcgccugaagcggauggccaucagcggcgacgacugcguggugaagcccaucgacgaccgcuucgccaacgcccuccuggcccugaacgacauggggaagguccggaaggacaucccccaguggcagcccuccaagggcuggcacgacuggcagcaggucccguucugcagccaccacuuccacgagcucaucaugaaggacgggcgcaagcuggugguccccugccggccccaggacgagcugaucggccgcgcgcggaucucccagggggccggcuggagccuccgcgagacggccugccugggcaaggccuacgcgcagauguggucccugauguacuuccaccgccgggaccuccgccuggccagcaacgccaucugcuccgccgugcccgugcacugggucccgaccagccggaccaccuggagcauccacgcccaccaccaguggaugacgaccgaggacaugcugaccguguggaaccgcguguggaucgaggacaaccccuggauggaggacaagacccccgucacgaccugggagaacgugcccuaccucgggaagcgggaggaccaguggugcggcucccugaucgggcugaccagccgcgcgaccugggcccagaacaucccgacggccauccagcagguccggucccucaucggcaacgaggaguuccuggacuacaugcccagcaugaagcgcuuccggaaggaggaggaguccgagggggccaucugguga

SEQ ID NO: 9843 - RNA, 9873 nt, Artificial Sequence
  derived and/or modified CDS sequence (opt1) from DENV-3__KT726347__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucgccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgucccgugcaagauccccuucagcaccgaggacgggcagggcaaggcccacaacggccgccugaucaccgccaaccccguggugacgaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgugggcgggguccucaacagccugggcaagauggugcaccagaucuucggguccgccuacaccgcccuguucagcggcguguccugggucaugaagaucggcaucggggugcuccugacguggaucggccugaacagcaagaacaccuccaugagcuucuccugcaucgccaucgggaucaucacccucuaccugggcgccgugguccaggcggacauggggugcgugaucaacuggaagggcaaggagcugaagugcggcagcgggaucuucgugaccaacgagguccacacguggaccgagcaguacaaguuccaggccgacucccccaagcgccucgccaccgccaucgccggcgcgugggagaacggggugugcggcauccgcagcaccacgcggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagacgugggggaaggccaagaucgucaccgccgagacccagaacagcuccuucaucaucgacggccccaacacccccgagugccccagcgcgucccgggccuggaacgugugggagguggaggacuacggguucggcgucuucacgaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcaccuggccgaagucccacacgcucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcaccacggucgugaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgcgauccuguucgaggaggugaugcgggggaaguucggcaagaagcacaugaucgccgggguguucuucacguucguccugcuccuguccggccagaucaccuggcgcgacauggcccacacccugaucaugaucggcagcaacgccuccgaccggauggggaugggcgugaccuaccucgcccugaucgcgacguucaagauccagcccuuccuggcccucggguucuuccugcgcaagcugaccagccgggagaaccuccugcugggcgugggccucgccauggccaccacccugcagcugcccgaggacaucgagcagauggcgaacgggaucgcccucggccugauggcccugaagcucaucacgcaguucgagaccuaccagcuguggaccgcccugaucagccugaccugcuccaacacgaucuucacccugaccgucgccuggcgcaccgcgacgcugauccucgccggggugagccugcugccggucugccaguccagcuccaugcggaagaccgacuggcuccccauggccguggccgccaugggcgugccgccccucccgcuguucaucuucagccucaaggacacccugaagcgccgcuccuggccccugaacgagggggucauggcggugggccucgugagcauccuggccuccagccugcuccggaacgacguccccauggccggcccccugguggccgggggccugcucaucgccugcuacgugaucaccgggacguccgcggaccugaccgucgagaaggccgccgacaucaccugggaggaggaggccgagcagaccggcgugagccacaaccugaugaucacgguggacgacgacgggaccaugcgcaucaaggacgacgagaccgagaacauccucaccguccugcugaagaccgcccuccugaucguguccggcaucuucccguacagcauccccgcgacgcugcucguguggcacaccuggcagaagcagacccagcgguccggcguccugugggacgugcccagcccgcccgagacccagaaggccgagcuggaggaggggguguaccgcaucaagcagcagggcaucuucgggaagacgcaggucggcgugggggugcagaaggagggcgucuuccacaccauguggcacgugacccggggcgccgugcucacccacaacgggaagcgccuggagcccaacugggccuccgucaagaaggaccugaucagcuacggcgggggcuggcggcucuccgcgcaguggcagaagggggaggagguccaggugaucgccgucgagcccggcaagaaccccaagaacuuccagacgaugcccggcaccuuccagaccaccacgggggagaucggcgccaucgcccuggacuucaagcccgggaccagcggcagccccaucaucaaccgcgagggcaaggugguggggcuguacggcaacggggucgugaccaagaacggcggguacguguccggcaucgcccagaccaacgcggagccggacggccccacgcccgagcuggaggaggagauguucaagaagcggaaccucaccaucauggaccugcaccccgggagcggcaagacccgcaaguaccugccggccaucguccgggaggccaucaagcgccggcuccgcacccugauccuggcccccacgcgggugguggccgcggagauggaggaggcccucaaggggcugcccauccgcuaccagaccaccgccaccaaguccgagcacacgggccgggagaucgucgaccugaugugccacgccaccuucaccaugcgccuccugagccccgugcgggugccgaacuacaaccugaucaucauggacgaggcccacuucaccgaccccgcguccaucgccgcccgcggguacaucagcacgcgggucggcaugggcgaggccgcggccaucuucaugaccgccacgccgcccgggaccgccgacgccuucccgcaguccaacgcgcccauccaggacgaggagcgcgacauccccgagcgcagcuggaacuccggcaacgaguggaucacggacuucgccgggaagaccgugugguucgugcccagcaucaaggccggcaacgacaucgccaacugccuccggaagaacgggaagaaggucauccagcugucccgcaagaccuucgacaccgaguaccagaagacgaagcugaacgacugggacuucguggugaccaccgacaucagcgagaugggcgccaacuucaaggcggaccgggucaucgacccgcgccggugccucaagcccgugauccugaccgacggccccgagcgcgugauccuggccgggcccaugccggucacggccgccuccgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagucccggaagaccuucguggagcugaugcgccgcggggaccuccccgucuggcuggcccacaagguggccagcgagggcaucaaguacacggaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcgcucaaggaguucaaggacuucgccgccggccgcaagagcaucgcccuggaccuggugaccgagaucgggcgggugcccucccaccucgcccaccgcacgcggaacgcgcuggacaaccuggucaugcuccacaccagcgagcacggcgggcgcgccuaccggcacgccguggaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugcucuggauggcggagaucccgcugcaguggaucgccagcgccaucguccuggaguucuucaugauggugcuccugauccccgagcccgagaagcagcgcacgccccaggacaaccagcuggccuacguggucaucgggauccucacccuggccgcgaucaucgccgccaacgagaugggccugcucgagacgaccaagcgggaccugggcauguccaaggagccggggguggugagccccaccuccuaccuggacgucgaccuccaccccgccagcgcguggacccuguacgccguggccacgaccgugaucacccccaugcugcgccacaccaucgagaacuccacggccaacgucagccucgccgcgaucgccaaccaggccguggugcugaugggccuggacaagggguggccgaucuccaagauggaccucggcgucccccugcuggcccucgggugcuacagccaggugaacccccugacccugaccgccgcggugcuccugcugaucacccacuacgccaucaucggccccggccuccaggccaaggccacgcgggaggcccagaagcgcaccgcggccgggaucaugaagaacccgaccgucgacggcaucaugaccaucgaccuggaccccgugaucuacgacuccaaguucgagaagcagcugggccaggugaugcuccugguccugugcgccgugcagcuccugcugaugcggacgagcugggcccucugcgaggcgcugacccuggccaccggccccaucaccacgcucugggagggcucccccgggaaguucuggaacaccaccaucgccgugagcauggccaacaucuuccgcggcuccuaccuggccggggcgggccuggccuucagcaucaugaaguccgucgggaccggcaagcggggcacggggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgcgggccugaagaaggucacggaggugcggggcuacaccaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccacgguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacccacgagauguacuggaucuccaacggcacggggaacaucguggccagcgucaacauggugucccggcuccugcugaaccgcuucaccaugacccaccggcgcccgaccaucgagaaggacguggaccucggcgccggcacgcggcacgucaacgccgagcccgagacccccaacauggacgugaucggggagcgcaucaagcggaucaaggaggagcacaacagcaccuggcacuacgacgacgagaacccguacaagaccugggccuaccacggcuccuacgaggugaaggcgacggggagcgccuccagcaugaucaacggcgucgugaagcugcugaccaagcccugggacgucgugcccauggugacccagauggccaugaccgacacgacccccuucgggcagcagcgcgucuucaaggagaagguggacacccggaccccgcgcagcaugcccggcacgcggcgcgugaugggcaucaccgccgaguggcucuggcggacccuggggcgcaacaagaagccccggcugugcacccgcgaggaguucacgaagaagguccgcaccaacgcggccaugggcgccguguucaccgaggagaaccagugggacuccgccaaggccgcgguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgcgauguacgccgacgacaccgccgggugggacacgcgcaucaccgaggacgaccugcacaacgaggagaagaucacccagcagauggacccggagcaccggcagcucgccaacgccaucuucaagcugaccuaccagaacaaggucgugaaggugcagcgccccacgcccaccggcaccgucauggacaucaucagccggaaggaccagcgcggcuccggccaggugggcaccuacgggcugaacaccuucacgaacauggaggcgcagcucauccggcagauggagggcgagggggugcugagcaaggccgaccuggagaacccccaccucccggagaagaagaucacccaguggcuggagaccaagggcgucgagcgccugaagcggauggccaucuccggcgacgacugcguggugaagcccaucgacgaccgcuucgccaacgcccuccuggcgcugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggccggcuggucccuccgcgagaccgccugccugggcaaggcguacgcccagauguggagccugauguacuuccaccgccgggaccuccgccuggccuccaacgccaucugcagcgccgugcccgugcacugggucccgacgucccggaccaccuggagcauccacgcgcaccaccaguggaugaccacggaggacaugcugaccguguggaaccgcguguggaucgaggacaaccccuggauggaggacaagacccccgucaccacgugggagaacgugcccuaccucgggaagcgggaggaccaguggugcggcagccugaucgggcugaccucccgcgccaccugggcccagaacaucccgaccgccauccagcagguccggagccucaucggcaacgaggaguuccuggacuacaugcccuccaugaagcgcuuccggaaggaggaggagagcgagggggccaucugguga

SEQ ID NO: 9844 - RNA, 9873 nt, Artificial Sequence
  derived and/or modified CDS sequence (opt1) from DENV-3__KT726352__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucagccucaaggacacccugaagcgccgcuccuggccccugaacgagggggucauggccgugggccucgugagcauccuggcguccagccugcuccggaacgacguccccauggccggcccccugguggccgggggccugcucaucgccugcuacgugaucacggggaccuccgccgaccugaccgucgagaaggcggccgacaucaccugggaggaggaggccgagcagacgggcgugagccacaaccugaugaucaccguggacgacgacgggaccaugcgcaucaaggacgacgagaccgagaacauccucaccguccugcugaagacggcccuccugaucguguccggcaucuucccguacagcauccccgccacccugcucguguggcacaccuggcagaagcagacccagcgguccggcguccugugggacgugcccagcccgcccgagacgcagaaggcggagcuggaggaggggguguaccgcaucaagcagcagggcaucuucgggaagacccaggucggcgugggggugcagaaggagggcgucuuccacaccauguggcacgugacccggggcgccgugcucacgcacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggcgaucguccgggaggccaucaagcgccggcuccgcacgcugauccuggcccccacccgggugguggccgccgagauggaggaggcgcucaaggggcugcccauccgcuaccagaccaccgccacgaaguccgagcacaccggccgggagaucgucgaccugaugugccacgccaccuucaccaugcgccuccugagccccgugcgggugccgaacuacaaccugaucaucauggacgaggcccacuucacggaccccgccuccaucgcggcccgcggguacaucagcacccgggucggcaugggcgaggccgccgcgaucuucaugaccgccacgccgcccgggacggccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagacguucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggacuucgcggccggccgcaagagcaucgcccuggaccuggugacggagaucgggcgggugcccucccaccucgcccaccgcacccggaacgcccuggacaaccuggucaugcuccacaccagcgagcacggcgggcgcgcguaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucguccuggaguucuucaugauggugcuccugauccccgagcccgagaagcagcgcacgccccaggacaaccagcuggccuacguggucaucgggauccucacgcuggccgccaucaucgcggccaacgagaugggccugcucgagaccaccaagcgggaccugggcauguccaaggagccggggguggugagccccaccuccuaccuggacgucgaccuccaccccgccagcgccuggacgcuguacgcgguggccaccaccgugaucacccccaugcugcgccacacgaucgagaacuccaccgccaacgucagccucgccgccaucgcgaaccaggccguggugcugaugggccuggacaagggguggccgaucuccaagauggaccucggcgucccccugcuggcccucgggugcuacagccaggugaacccccugacccugaccgccgccgugcuccugcugaucacgcacuacgcgaucaucggccccggccuccaggccaaggccacccgggaggcccagaagcgcaccgccgcggggaucaugaagaacccgaccgucgacggcaucaugacgaucgaccuggaccccgugaucuacgacuccaaguucgagaagcagcugggccaggugaugcuccugguccugugcgccgugcagcuccugcugaugcggaccagcugggcccucugcgaggcccugacccuggcgaccggccccaucacgacccucugggagggcucccccgggaaguucuggaacaccaccaucgccgugagcauggccaacaucuuccgcggcuccuaccuggccggggccggccuggcguucagcaucaugaaguccgucgggacgggcaagcggggcaccgggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagaucacgcaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacgcacgagauguacuggaucuccaacggcaccgggaacaucguggcgagcgucaacauggugucccggcuccugcugaaccgcuucaccaugacccaccggcgcccggccaucgagaaggacguggaccucggcgccggcacgcggcacgucaacgccgagcccgagacccccaacauggacgugaucggggagcgcaucaagcggaucaaggaggagcacaacagcaccuggcacuacgacgacgagaacccguacaagaccugggccuaccacggcuccuacgaggugaaggcgacggggagcgccuccagcaugaucaacggcgucgugaagcugcugaccaagcccugggacgucgugcccauggugacccagauggccaugaccgacacgacccccuucgggcagcagcgcgucuucaaggagaagguggacacccggaccccgcgcagcaugcccggcacgcggcgcgugaugggcaucaccgccgaguggcucuggcggacccuggggcgcaacaagaagccccggcugugcacccgcgaggaguucacgaagaagguccgcaccaacgcggccaugggcgccguguucaccgaggagaaccagugggacuccgccaaggccgcgguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgcgauguacgccgacgacaccgccgggugggacacgcgcaucaccgaggacgaccugcacaacgaggagaagaucacccagcagauggacccggagcaccggcagcucgccaacgccaucuucaagcugaccuaccagaacaaggucgugaaggugcagcgccccacgcccaccggcaccgucauggacaucaucagccggaaggaccagcgcggcuccggccaggugggcaccuacgggcugaacaccuucacgaacauggaggcgcagcucauccggcagauggagggcgagggggugcugagcaaggccgaccuggagaacccccaccucccggagaagaagaucacccaguggcuggagaccaagggcgucgagcgccugaagcggauggccaucuccggcgacgacugcguggugaagcccaucgacgaccgcuucgccaacgcccuccuggcgcugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggccggcuggucccuccgcgagaccgccugccugggcaaggcguacgcccagauguggagccugauguacuuccaccgccgggaccuccgccuggccuccaacgccaucugcagcgccgugcccgugcacugggucccgacgucccggaccaccuggagcauccacgcgcaccaccaguggaugaccacggaggacaugcugaccguguggaaccgcguguggaucgaggacaaccccuggauggaggacaagacccccgucaccacgugggagaacgugcccuaccucgggaagcgggaggaccaguggugcggcagccugaucgggcugaccucccgcgccaccugggcccagaacaucccgaccgccauccagcagguccggagccucaucggcaacgaggaguuccuggacuacaugcccuccaugaagcgcuuccggaaggaggaggagagcgagggggccaucugguga

SEQ ID NO: 9845 - RNA, 9873 nt, Artificial Sequence
  derived and/or modified CDS sequence (opt1) from DENV-3__KT726356__SS-prME
accagccugugccucaugaugauccugcccgccgcccuggcguuccaccucaccagccgggacggggagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccugccgcuguucaucuucagccucaaggacacccugaagcgccgcuccuggccccugaacgagggggucauggccgugggccucgugagcauccuggcguccagccugcuccggaacgacguccccauggccggcccccugcuggccgggggccuccugaucgccugcuacgugaucacggggaccuccgccgaccugaccguggagaaggcggccgacaucaccugggaggaggaggccgagcagacgggcgucagccacaaccucaugaucaccguggacgacgacgggaccaugcgcaucaaggacgacgagaccgagaacauccugaccgugcugcucaagacggcccugcugaucgucuccggcaucuucccguacagcauccccgccacccuccugguguggcacaccuggcagaagcagacccagcgguccggcgugcugugggacguccccagcccgcccgagacgcagaaggcggagcucgaggaggggguguaccgcaucaagcagcagggcaucuucgggaagacccaggugggcgucggggugcagaaggagggcguguuccacaccauguggcacgucacccggggcgccgugcugacgcacaacgggaagcgccuggagcccaacugggccuccgugaagaaggaccucaucagcuacggcgggggcuggcggcuguccgcccaguggcagaagggggaggagguccaggugaucgcgguggagcccggcaagaaccccaagaacuuccagaccaugcccggcaccuuccagaccacgaccggggagaucggcgccaucgcccuggacuucaagcccgggaccagcggcagccccaucaucaaccgcgagggcaaggucguggggcuguacggcaacgggguggucaccaagaacggcggguacguguccggcaucgcccagacgaacgccgagccggacggccccacccccgagcucgaggaggagauguucaagaagcggaaccugaccaucauggaccugcaccccgggagcggcaagacccgcaaguaccucccggcgaucgugcgggaggccaucaagcgccggcugcgcacgcugauccucgcccccacccgggucguggccgccgagauggaggaggcgcugaaggggcugcccauccgcuaccagaccaccgccacgaaguccgagcacaccggccgggagaucguggaccucaugugccacgccaccuucaccaugcgccugcugagccccguccgggugccgaacuacaaccucaucaucauggacgaggcccacuucacggaccccgccuccaucgcggcccgcggguacaucagcacccgggugggcaugggcgaggccgccgcgaucuucaugaccgccacgccgcccgggacggccgacgccuucccgcaguccaacgcccccauccaggacgaggagcgcgacauccccgagcgcagcuggaacuccggcaacgaguggaucaccgacuucgcggggaagaccgucugguucgugcccagcaucaaggccggcaacgacaucgccaacugccugcggaagaacgggaagaaggugauccagcugucccgcaagaccuucgacacggaguaccagaagaccaagcucaacgacugggacuucgucgugaccaccgacaucagcgagaugggcgccaacuucaaggccgaccgggugaucgacccgcgccggugccugaagcccgucauccugacggacggccccgagcgcgugauccucgcggggcccaugccggugaccgccgccuccgccgcccagcggcgcggccgggucgggcgcaacccccagaaggagaacgaccaguacaucuucaccggccagccccugaacaacgacgaggaccacgcgcacuggaccgaggccaagaugcugcucgacaacaucaacacccccgaggggaucaucccggcccuguucgagcccgagcgggagaaguccgccgcgaucgacggcgaguaccgccugaagggcgagucccggaagacguucguggagcucaugcgccgcggggaccugcccguguggcuggcccacaaggucgccagcgagggcaucaaguacaccgaccgcaaguggugcuucgacgggcagcggaacaaccagauccucgaggagaacauggacguggagaucuggaccaaggagggcgagaagaagaagcugcgcccccgguggcuggacgcccgcaccuacuccgacccgcucgcccugaaggaguucaaggacuucgcggccggccgcaagagcaucgcccuggaccucgucacggagaucgggcgggugcccucccaccuggcccaccgcacccggaacgcccuggacaaccucgugaugcugcacaccagcgagcacggcgggcgcgcguaccggcacgccgucgaggagcugcccgagaccauggagacgcuccugcugcucggccugaugauccugcucaccgggggcgccaugcuguuccugaucagcggcaaggggaucggcaagaccuccaucgggcucaucugcgugaucgccagcuccggcaugcuguggauggccgagaucccgcugcaguggaucgcgagcgccaucgugcucgaguucuucaugaugguccugcugauccccgagcccgagaagcagcgcacgccccaggacaaccagcucgccuacguggugaucgggauccugacgcuggccgccaucaucgcggccaacgagaugggccuccuggagaccaccaagcgggaccugggcauguccaaggagccgggggucgugagccccaccuccuaccucgacguggaccugcaccccgccagcgccuggacgcuguacgcggucgccaccaccgugaucacccccaugcuccgccacacgaucgagaacuccaccgccaacgugagccuggccgccaucgcgaaccaggccgucgugcugaugggccucgacaagggguggccgaucuccaagauggaccugggcgugccccugcucgcccuggggugcuacagccaggucaacccccugacccucaccgccgccgugcugcugcucaucacgcacuacgcgaucaucggccccggccugcaggccaaggccacccgggaggcccagaagcgcaccgccgcggggaucaugaagaacccgaccguggacggcaucaugacgaucgaccuggaccccgucaucuacgacuccaaguucgagaagcagcucggccaggugaugcugcuggugcucugcgccguccagcugcugcucaugcggaccagcugggcccugugcgaggcccugacccucgcgaccggccccaucacgacccugugggagggcucccccgggaaguucuggaacaccaccaucgccgugagcauggccaacaucuuccgcggcuccuaccuggccggggccggccucgcguucagcaucaugaaguccguggggacgggcaagcggggcaccgggagccagggcgagacccugggggagaaguggaagaagaagcugaaccagcucagccgcaaggaguucgaccuguacaagaaguccggcaucaccgaggucgaccggaccgaggccaaggaggggcugaagcgcggcgagaucacgcaccacgccgugagccggggcuccgccaagcuccagugguucguggagcgcaacauggucaucccggaggggcgggugaucgaccugggcugcgggcgcggcggguggagcuacuacugcgccggccugaagaaggugaccgagguccggggcuacaccaagggcgggcccgggcacgaggagcccgugcccauguccaccuacggcuggaacaucgugaagcucaugagcgggaaggacgucuucuaccugccgcccgagaagugcgacacgcugcugugcgacaucggcgaguccagccccucccccaccguggaggagagccgcaccauccgcgugcucaagauggucgagccguggcugaagaacaaccaguucugcaucaaggugcugaaccccuacaugcccaccgugaucgagcaccucgagcggcugcagcgcaagcacggcgggaugcugguccggaacccccucucccgcaacagcacgcacgagauguacuggaucuccaacggcaccgggaacaucguggcgagcgugaacauggucucccggcugcugcucaaccgcuucaccaugaccuaccggcgcccgacgaucgagaaggacguggaccugggcgccggcacccggcacgugaacgccgagcccgagacccccaacauggacgucaucggggagcgcaucaagcggaucaaggaggagcacaacagcaccuggcacuacgacgacgagaacccguacaagacgugggccuaccacggcuccuacgaggugaaggccaccgggagcgcguccagcaugaucaacggcguggucaagcugcucaccaagcccugggacgugguccccauggugacccagauggccaugacggacaccacccccuucgggcagcagcgcguguucaaggagaaggucgacacccggacgccgcgcagcaugcccggcacccggcgcgugaugggcaucaccgccgaguggcuguggcggacccuggggcgcaacaagaagccccggcucugcacgcgcgaggaguucaccaagaaggugcgcaccaacgccgcgaugggcgccgucuucaccgaggagaaccagugggacuccgccaaggccgccguggaggacgaggacuucuggaagcugguggaccgggagcgcgagcugcacaagcucgggaagugcggcagcugcgucuacaacaugauggggaagcgggagaagaagcugggcgaguucggcaaggcgaaggggucccgcgccaucugguacauguggcugggcgcccgguaccucgaguucgaggcccugggguuccugaacgaggaccacugguucagccgcgagaacuccuacagcggcguggagggggagggccuccacaagcugggcuacauccugcgggacaucuccaagauccccgggggcgccauguacgcggacgacacggccgggugggacacccgcaucaccgaggacgaccuccacaacgaggagaagaucacccagcagauggacccggagcaccggcagcuggccaacgccaucuucaagcugacguaccagaacaagguggucaaggugcagcgccccacccccaccggcaccgugauggacaucaucagccggaaggaccagcgcggcuccgggcaggucggcaccuacgggcucaacacguucaccaacauggaggcccagcugauccggcagauggagggcgagggggugcugagcaaggcggaccucgagaacccccaccuccccgagaagaagaucacccaguggcuggagaccaagggcguggagcgccugaagcggauggccaucuccggcgacgacugcgucgugaagcccaucgacgaccgcuucgccaacgcccugcuggcccucaacgacauggggaaggugcggaaggacaucccccaguggcagcccagcaagggcuggcacgacuggcagcaggucccguucugcucccaccacuuccacgagcugaucaugaaggacgggcgcaagcugguggugcccugccggccccaggacgagcucaucggccgcgcgcggaucagccagggggccggcuggucccugcgcgagacggccugccugggcaaggccuacgcgcagauguggagccucauguacuuccaccgccgggaccugcgccuggccuccaacgccaucugcagcgccguccccgugcacugggugccgaccucccggaccaccuggagcauccacgcccaccaccaguggaugacgaccgaggacaugcucaccgucuggaaccgcguguggaucgaggacaaccccuggauggaggacaagacccccgugacgaccugggagaacguccccuaccuggggaagcgggaggaccaguggugcggcagccugaucgggcucaccucccgcgcgaccugggcccagaacaucccgacggccauccagcagguccggagccugaucggcaacgaggaguuccuggacuacaugcccuccaugaagcgcuuccggaaggaggaggagagcgagggggccaucugguga

SEQ ID NO: 9846 - RNA, 9873 nt, Artificial Sequence
  derived and/or modified CDS sequence (opt1) from DENV-3__KT726342__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucagccucaaggacacccugaagcgccgcuccuggccccugaacgagggggucauggccgugggccucgugagcauccuggcguccagccugcuccggaacgacguccccauggccggcccccugguggccgggggccugcucaucgccugcuacgugaucacggggaccuccgccgaccugaccgucgagaaggcggccgacaucaccugggaggaggaggccgagcagacgggcgugagccacaaccugaugaucaccguggacgacgacgggaccaugcgcaucaaggacgacgagaccgagaacauccucaccguccugcugaagacggcccuccugaucguguccggcaucuucccguacagcauccccgccacccugcucguguggcacaccuggcagaagcagacccagcgguccggcguccugugggacgugcccagcccgcccgagacgcagaaggcggagcuggaggaggggguguaccgcaucaagcagcagggcaucuucgggaagacccaggucggcgugggggugcagaaggagggcgucuuccacaccauguggcacgugacccggggcgccgugcucacgcacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggcgaucguccgggaggccaucaagcgccggcuccgcacgcugauccuggcccccacccgggugguggccgccgagauggaggaggcgcucaaggggcugcccauccgcuaccagaccaccgccacgaaguccgagcacaccggccgggagaucgucgaccugaugugccacgccaccuucaccaugcgccuccugagccccgugcgggugccgaacuacaaccugaucaucauggacgaggcccacuucacggaccccgccuccaucgcggcccgcggguacaucagcacccgggucggcaugggcgaggccgccgcgaucuucaugaccgccacgccgcccgggacggccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagacguucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggacuucgcggccggccgcaagagcaucgcccuggaccuggugacggagaucgggcgggugcccucccaccucgcccaccgcacccggaacgcccuggacaaccuggucaugcuccacaccagcgagcacggcgggcgcgcguaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucguccuggaguucuucaugauggugcuccugauccccgagcccgagaagcagcgcacgccccaggacaaccagcuggccuacguggucaucgggauccucacgcuggccgccaucaucgcggccaacgagaugggccugcucgagaccaccaagcgggaccugggcauguccaaggagccggggguggugagccccaccuccuaccuggacgucgaccuccaccccgccagcgccuggacgcuguacgcgguggccaccaccgugaucacccccaugcugcgccacacgaucgagaacuccaccgccaacgucagccucgccgccaucgcgaaccaggccguggugcugaugggccuggacaagggguggccgaucuccaagauggaccucggcgucccccugcuggcccucgggugcuacagccaggugaacccccugacccugaccgccgccgugcuccugcugaucacgcacuacgcgaucaucggccccggccuccaggccaaggccacccgggaggcccagaagcgcaccgccgcggggaucaugaagaacccgaccgucgacggcaucaugacgaucgaccuggaccccgugaucuacgacuccaaguucgagaagcagcugggccaggugaugcuccugguccugugcgccgugcagcuccugcugaugcggaccagcugggcccucugcgaggcccugacccuggcgaccggccccaucacgacccucugggagggcucccccgggaaguucuggaacaccaccaucgccgugagcauggccaacaucuuccgcggcuccuaccuggccggggccggccuggcguucagcaucaugaaguccgucgggacgggcaagcggggcaccgggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagaucacgcaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacgcacgagauguacuggaucuccaacggcaccgggaacaucguggcgagcgucaacauggugucccggcuccugcugaaccgcuucaccaugacccaccggcgcccgacgaucgagaaggacguggaccucggcgccggcacccggcacgucaacgccgagcccgagacccccaacauggacgugaucggggagcgcaucaagcggaucaaggaggagcacaacagcaccuggcacuacgacgacgagaacccguacaagacgugggccuaccacggcuccuacgaggugaaggccaccgggagcgcguccagcaugaucaacggcgucgugaagcugcugaccaagcccugggacgucgugcccauggugacccagauggccaugacggacaccacccccuucgggcagcagcgcgucuucaaggagaagguggacacccggacgccgcgcagcaugcccggcacccggcgcgugaugggcaucaccgccgaguggcucuggcggacccuggggcgcaacaagaagccccggcugugcacgcgcgaggaguucaccaagaagguccgcaccaacgccgcgaugggcgccguguucaccgaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgcggacgacacggccgggugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucagccggaaggaccagcgcggcuccggccaggugggcaccuacgggcugaacacguucaccaacauggaggcccagcucauccggcagauggagggcgagggggugcugagcaaggcggaccuggagaacccccaccucccggagaagaagaucacccaguggcuggagaccaagggcgucgagcgccugaagcggauggccaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcgcggaucagccagggggccggcuggucccuccgcgagacggccugccugggcaaggccuacgcgcagauguggagccugauguacuuccaccgccgggaccuccgccuggccuccaacgccaucugcagcgccgugcccgugcacugggucccgaccucccggaccaccuggagcauccacgcccaccaccaguggaugacgaccgaggacaugcugaccguguggaaccgcguguggaucgaggacaaccccuggauggaggacaagacccccgucacgaccugggagaacgugcccuaccucgggaagcgggaggaccaguggugcggcagccugaucgggcugaccucccgcgcgaccugggcccagaacaucccgacggccauccagcagguccggagccucaucggcaacgaggaguuccuggacuacaugcccuccaugaagcgcuuccggaaggaggaggagagcgagggggccaucugguga

SEQ ID NO: 9847 - RNA, 9873 nt, Artificial Sequence
  derived and/or modified CDS sequence (opt1) from DENV-3__KT726343__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccguggccuggcgcacggcgacccugauccucgccggggucagccugcugccggugugccaguccagcuccaugcggaagaccgacuggcuccccauggccgucgccgccaugggcgugccgccccucccgcuguucaucuucagccucaaggacacccugaagcgccgcuccuggccccugaacgagggggugauggcggucggccucgugagcauccuggccuccagccugcuccggaacgacgugcccauggccggcccccuggucgccgggggccugcucaucgccugcuacgugaucacggggaccuccgcggaccugaccguggagaaggccgccgacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcaucuucccguacagcauccccgcgacccugcucguguggcacaccuggcagaagcagacccagcgguccggcgugcugugggacguccccagcccgcccgagacgcagaaggccgagcuggaggaggggguguaccgcaucaagcagcagggcaucuucgggaagacccaggugggcgucggggugcagaaggagggcguguuccacaccauguggcacgucacccggggcgccgugcucacgcacaacgggaagcgccuggagcccaacugggccuccgugaagaaggaccugaucagcuacggcgggggcuggcggcucuccgcgcaguggcagaagggggaggagguccaggugaucgccguggagcccggcaagaaccccaagaacuuccagaccaugcccggcaccuuccagaccacgaccggggagaucggcgccaucgcccuggacuucaagcccgggaccagcggcagccccaucaucaaccgcgagggcaaggucguggggcuguacggcaacgggguggucaccaagaacggcggguacguguccggcaucgcccagacgaacgcggagccggacggccccacccccgagcuggaggaggagauguucaagaagcggaaccucaccaucauggaccugcaccccgggagcggcaagacccgcaaguaccugccggccaucgugcgggaggccaucaagcgccggcuccgcacgcugauccuggcccccacccgggucguggccgcggagauggaggaggcccucaaggggcugcccauccgcuaccagaccaccgccacgaaguccgagcacaccggccgggagaucguggaccugaugugccacgccaccuucaccaugcgccuccugagccccguccgggugccgaacuacaaccugaucaucauggacgaggcccacuucacggaccccgcguccaucgccgcccgcggguacaucagcacccgggugggcaugggcgaggccgcggccaucuucaugaccgccacgccgcccgggacggccgacgccuucccgcaguccaacgcgcccauccaggacgaggagcgcgacauccccgagcgcagcuggaacuccggcaacgaguggaucaccgacuucgccgggaagaccgucugguucgugcccagcaucaaggccggcaacgacaucgccaacugccuccggaagaacgggaagaaggugauccagcugucccgcaagaccuucgacacggaguaccagaagaccaagcugaacgacugggacuucgucgugaccaccgacaucagcgagaugggcgccaacuucaaggcggaccgggugaucgacccgcgccggugccucaagcccgucauccugacggacggccccgagcgcgugauccuggccgggcccaugccggugaccgccgccuccgccgcgcagcggcgcggccgggucgggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagucccggaagacguucguggagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcgcucaaggaguucaaggacuucgccgccggccgcaagagcaucgcccuggaccuggucacggagaucgggcgggugcccucccaccucgcccaccgcacccggaacgcgcuggacaaccuggugaugcuccacaccagcgagcacggcgggcgcgccuaccggcacgccgucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucgugcuggaguucuucaugaugguccuccugauccccgagcccgagaagcagcgcacgccccaggacaaccagcuggccuacguggugaucgggauccucacgcuggccgcgaucaucgccgccaacgagaugggccugcucgagaccaccaagcgggaccugggcauguccaaggagccgggggucgugagccccaccuccuaccuggacguggaccuccaccccgccagcgcguggacgcuguacgccgucgccaccaccgugaucacccccaugcugcgccacacgaucgagaacuccaccgccaacgugagccucgccgcgaucgccaaccaggccgucgugcugaugggccuggacaagggguggccgaucuccaagauggaccucggcgugccccugcuggcccucgggugcuacagccaggucaacccccugacccugaccgccgcggugcuccugcugaucacgcacuacgccaucaucggccccggccuccaggccaaggccacccgggaggcccagaagcgcaccgcggccgggaucaugaagaacccgaccguggacggcaucaugacgaucgaccuggaccccgucaucuacgacuccaaguucgagaagcagcugggccaggugaugcuccuggugcugugcgccguccagcuccugcugaugcggaccagcugggcccucugcgaggcgcugacccuggccaccggccccaucacgacccucugggagggcucccccgggaaguucuggaacaccaccaucgccgugagcauggccaacaucuuccgcggcuccuaccuggccggggcgggccuggccuucagcaucaugaaguccguggggacgggcaagcggggcaccgggagccagggcgagacccucggggagaaguggaagaagaagcugaaccagcugagccgcaaggaguucgaccucuacaagaaguccggcaucaccgaggucgaccggaccgaggccaaggaggggcugaagcgcggcgagaucacgcaccacgccgugagccggggcuccgccaagcugcagugguucguggagcgcaacauggucaucccggaggggcgggugaucgaccucggcugcgggcgcggcggguggagcuacuacugcgcgggccugaagaaggugaccgagguccggggcuacaccaagggcgggcccgggcacgaggagcccgugcccauguccaccuacggcuggaacaucgugaagcugaugagcgggaaggacgucuucuaccucccgcccgagaagugcgacacgcugcugugcgacaucggcgaguccagccccucccccaccguggaggagagccgcaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugucccgcaacagcacgcacgagauguacuggaucuccaacggcaccgggaacaucguggccagcgugaacauggucucccggcuccugcugaaccgcuucaccaugacccaccggcgcccgacgaucgagaaggacguggaccucggcgccggcacccggcacgugaacgccgagcccgagacccccaacauggacgucaucggggagcgcaucaagcggaucaaggaggagcacaacagcaccuggcacuacgacgacgagaacccguacaagacgugggccuaccacggcuccuacgaggugaaggcgaccgggagcgccuccagcaugaucaacggcguggucaagcugcugaccaagcccugggacgugguccccauggugacccagauggccaugacggacaccacccccuucgggcagcagcgcguguucaaggagaaggucgacacccggacgccgcgcagcaugcccggcacccggcgcgugaugggcaucaccgccgaguggcucuggcggacccuggggcgcaacaagaagccccggcugugcacgcgcgaggaguucaccaagaaggugcgcaccaacgcggccaugggcgccgucuucaccgaggagaaccagugggacuccgccaaggccgcgguggaggacgaggacuucuggaagcucguggaccgggagcgcgagcugcacaagcuggggaagugcggcagcugcgucuacaacaugauggggaagcgggagaagaagcucggcgaguucggcaaggccaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgcgauguacgccgacgacacggccgggugggacacccgcaucaccgaggacgaccugcacaacgaggagaagaucacccagcagauggacccggagcaccggcagcucgccaacgccaucuucaagcugacguaccagaacaagguggucaaggugcagcgccccacccccaccggcaccgugauggacaucaucagccggaaggaccagcgcggcuccgggcaggucggcaccuacgggcugaacacguucaccaacauggaggcgcagcucauccggcagauggagggcgagggggugcugagcaaggccgaccuggagaacccccaccucccggagaagaagaucacccaguggcuggagaccaagggcguggagcgccugaagcggauggccaucuccggcgacgacugcgucgugaagcccaucgacgaccgcuucgccaacgcccuccuggcgcugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcccggaucagccagggggccggcuggucccuccgcgagacggccugccugggcaaggcguacgcccagauguggagccugauguacuuccaccgccgggaccuccgccuggccuccaacgccaucugcagcgccguccccgugcacugggugccgaccucccggaccaccuggagcauccacgcgcaccaccaguggaugacgaccgaggacaugcugaccgucuggaaccgcguguggaucgaggacaaccccuggauggaggacaagacccccgugacgaccugggagaacguccccuaccucgggaagcgggaggaccaguggugcggcagccugaucgggcugaccucccgcgccaccugggcccagaacaucccgacggccauccagcagguccggagccucaucggcaacgaggaguuccuggacuacaugcccuccaugaagcgcuuccggaaggaggaggagagcgagggggccaucugguga

SEQ ID NO: 9848 - RNA, 9873 nt, Artificial Sequence
  derived and/or modified CDS sequence (opt1) from DENV-3__KT726351__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucagccucaaggacacccugaagcgccgcuccuggccccugaacgagggggucauggccgugggccucgugagcauccuggcguccagccugcuccggaacgacguccccauggccggcccccugguggccgggggccugcucaucgccugcuacgugaucacggggaccuccgccgaccugaccgucgagaaggcggccgacaucaccugggaggaggaggccgagcagacgggcgugagccacaaccugaugaucaccguggacgacgacgggaccaugcgcaucaaggacgacgagaccgagaacauccucaccguccugcugaagacggcccuccugaucguguccggcaucuucccguacagcauccccgccacccugcucguguggcacaccuggcagaagcagacccagcgguccggcguccugugggacgugcccagcccgcccgagacgcagaaggcggagcuggaggaggggguguaccgcaucaagcagcagggcaucuucgggaagacccaggucggcgugggggugcagaaggagggcgucuuccacaccauguggcacgugacccggggcgccgugcucacgcacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggcgaucguccgggaggccaucaagcgccggcuccgcacgcugauccuggcccccacccgggugguggccgccgagauggaggaggcgcucaaggggcugcccauccgcuaccagaccaccgccacgaaguccgagcacaccggccgggagaucgucgaccugaugugccacgccaccuucaccaugcgccuccugagccccgugcgggugccgaacuacaaccugaucaucauggacgaggcccacuucacggaccccgccuccaucgcggcccgcggguacaucagcacccgggucggcaugggcgaggccgccgcgaucuucaugaccgccacgccgcccgggacggccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagacguucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggacuucgcggccggccgcaagagcaucgcccuggaccuggugacggagaucgggcgggugcccucccaccucgcccaccgcacccggaacgcccuggacaaccuggucaugcuccacaccagcgagcacggcgggcgcgcguaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucguccuggaguucuucaugauggugcuccugauccccgagcccgagaagcagcgcacgccccaggacaaccagcuggccuacguggucaucgggauccucacgcuggccgccaucaucgcggccaacgagaugggccugcucgagaccaccaagcgggaccugggcauguccaaggagccggggguggugagccccaccuccuaccuggacgucgaccuccaccccgccagcgccuggacgcuguacgcgguggccaccaccgugaucacccccaugcugcgccacacgaucgagaacuccaccgccaacgucagccucgccgccaucgcgaaccaggccguggugcugaugggccuggacaagggguggccgaucuccaagauggaccucggcgucccccugcuggcccucgggugcuacagccaggugaacccccugacccugaccgccgccgugcuccugcugaucacgcacuacgcgaucaucggccccggccuccaggccaaggccacccgggaggcccagaagcgcaccgccgcggggaucaugaagaacccgaccgucgacggcaucaugacgaucgaccuggaccccgugaucuacgacuccaaguucgagaagcagcugggccaggugaugcuccugguccugugcgccgugcagcuccugcugaugcggaccagcugggcccucugcgaggcccugacccuggcgaccggccccaucacgacccucugggagggcucccccgggaaguucuggaacaccaccaucgccgugagcauggccaacaucuuccgcggcuccuaccuggccggggccggccuggcguucagcaucaugaaguccgucgggacgggcaagcggggcaccgggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagaucacgcaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacgcacgagauguacuggaucuccaacggcaccgggaacaucguggcgagcgucaacauggugucccggcuccugcugaaccgcuucaccaugacccaccggcgcccgacgaucgagaaggacguggaccucggcgccggcacccggcacgucaacgccgagcccgagacccccaacauggacgugaucggggagcgcaucaagcggaucaaggaggagcacaacagcaccuggcacuacgacgacgagaacccguacaagacgugggccuaccacggcuccuacgaggugaaggccaccgggagcgcguccagcaugaucaacggcgucgugaagcugcugaccaagcccugggacgucgugcccauggugacccagauggccaugacggacaccacccccuucgggcagcagcgcgucuucaaggagaagguggacacccggacgccgcgcagcaugcccggcacccggaaggugaugggcaucaccgccgaguggcucuggcgcacccuggggcggaacaagaagccccgccugugcacgcgggaggaguucaccaagaagguccgcaccaacgccgcgaugggcgccguguucaccgaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacacggccgggugggacacccggaucaccgaggacgaccugcacaacgaggagaagaucacccagcagauggacccggagcaccgccagcucgccaacgccaucuucaagcugacguaccagaacaaggucgugaaggugcagcggcccacccccaccggcaccgucauggacaucaucagccgcaaggaccagcggggcuccggccaggugggcaccuacgggcugaacacguucaccaacauggaggcccagcucauccgccagauggagggcgagggggugcugagcaaggcggaccuggagaacccccaccucccggagaagaagaucacccaguggcuggagaccaagggcgucgagcggcugaagcgcauggccaucuccggcgacgacugcguggugaagcccaucgacgaccgguucgccaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcgcgcaucagccagggggccggcuggucccuccgggagacggccugccugggcaaggccuacgcgcagauguggagccugauguacuuccaccgccgcgaccuccggcuggccuccaacgccaucugcagcgccgugcccgugcacugggucccgaccucccgcaccaccuggagcauccacgcccaccaccaguggaugacgaccgaggacaugcugaccguguggaaccggguguggaucgaggacaaccccuggauggaggacaagacccccgucacgaccugggagaacgugcccuaccucgggaagcgcgaggaccaguggugcggcagccugaucgggcugaccucccgggcgaccugggcccagaacaucccgacggccauccagcagguccgcagccucaucggcaacgaggaguuccuggacuacaugcccuccaugaagcgguuccgcaaggaggaggagagcgagggggccaucugguga

SEQ ID NO: 9849 - RNA, 9873 nt, Artificial Sequence
  derived and/or modified CDS sequence (opt1) from DENV-3__KT726360__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucagccucaaggacacccugaagcgccgcuccuggccccugaacgagggggucauggccgugggccucgugagcauccuggcguccagccugcuccggaacgacguccccauggccggcccccugguggccgggggccugcucaucgccugcuacgugaucacggggaccuccgccgaccugaccgucgagaaggcggccgacaucaccugggaggaggaggccgagcagacgggcgugagccacaaccugaugaucaccguggacgacgacgggaccaugcgcaucaaggacgacgagaccgagaacauccucaccguccugcugaagacggcccuccugaucguguccggcaucuucccguacagcauccccgccacccugcucguguggcacaccuggcagaagcagacccagcgguccggcguccugugggacgugcccagcccgcccgagacgcagaaggcggagcuggaggaggggguguaccgcaucaagcagcagggcaucuucgggaagacccaggucggcgugggggugcagaaggagggcgucuuccacaccauguggcacgugacccggggcgccgugcucacgcacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggcgaucguccgggaggccaucaagcgccggcuccgcacgcugauccuggcccccacccgggugguggccgccgagauggaggaggcgcucaaggggcugcccauccgcuaccagaccaccgccacgaaguccgagcacaccggccgggagaucgucgaccugaugugccacgccaccuucaccaugcgccuccugagccccgugcgggugccgaacuacaaccugaucaucauggacgaggcccacuucacggaccccgccuccaucgcggcccgcggguacaucagcacccgggucggcaugggcgaggccgccgcgaucuucaugaccgccacgccgcccgggacggccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagacguucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggacuucgcggccggccgcaagagcaucgcccuggaccuggugacggagaucgggcgggugcccucccaccucgcccaccgcacccggaacgcccuggacaaccuggucaugcuccacaccagcgagcacggcgggcgcgcguaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucguccuggaguucuucaugauggugcuccugauccccgagcccgagaagcagcgcacgccccaggacaaccagcuggccuacguggucaucgggauccucacgcuggccgccaucaucgcggccaacgagaugggccugcucgagaccaccaagcgggaccugggcauguccaaggacccggggguggugagccccaccuccuaccuggacgucgaccuccaccccgccagcgccuggacgcuguacgcgguggccaccaccgugaucacccccaugcugcgccacacgaucgagaacuccaccgccaacgucagccucgccgccaucgcgaaccaggccguggugcugaugggccuggacaagggguggccgaucuccaagauggaccucggcgucccccugcuggcccucgggugcuacagccaggugaacccccugacccugaccgccgccgugcuccugcugaucacgcacuacgcgaucaucggccccggccuccaggccaaggccacccgggaggcccagaagcgcaccgccgcggggaucaugaagaacccgaccgucgacggcaucaugacgaucgaccuggaccccgugaucuacgacuccaaguucgagaagcagcugggccaggugaugcuccugguccugugcgccgugcagcuccugcugaugcggaccagcugggcccucugcgaggcccugacccuggcgaccggccccaucacgacccucugggagggcucccccgggaaguucuggaacaccaccaucgccgugagcauggccaacaucuuccgcggcuccuaccuggccggggccggccuggcguucagcaucaugaaguccgucgggacgggcaagcggggcaccgggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagaucacgcaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacgcacgagauguacuggaucuccaacggcaccgggaacaucguggcgagcgucaacauggugucccggcuccugcugaaccgcuucaccaugacccaccggcgcccgacgaucgagaaggacguggaccucggcgccggcacccggcacgucaacgccgagcccgagacccccaacauggacgugaucggggagcgcaucaagcggaucaaggaggagcacaacagcaccuggcacuacgacgacgagaacccguacaagacgugggccuaccacggcuccuacgaggugaaggccaccgggagcgcguccagcaugaucaacggcgucgugaagcugcugaccaagcccugggacgucgugcccauggugacccagauggccaugacggacaccacccccuucgggcagcagcgcgucuucaaggagaagguggacacccggacgccgcgcagcaugcccggcacccggcgcgugaugggcaucaccgccgaguggcucuggcggacccuggggcgcaacaagaagccccggcugugcacgcgcgaggaguucaccaagaagguccgcaccaacgccgcgaugggcgccguguucaccgaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgcggacgacacggccgggugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucagccggaaggaccagcgcggcuccggccaggugggcaccuacgggcugaacacguucaccaacauggaggcccagcucauccggcagauggagggcgagggggugcugagcaaggcggaccuggagaacccccaccucccggagaagaagaucacccaguggcuggagaccaagggcgucgagcgccugaagcggauggccaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcgcggaucagccagggggccggcuggucccuccgcgagacggccugccugggcaaggccuacgcgcagauguggagccugauguacuuccaccgccgggaccuccgccuggccuccaacgccaucugcagcgccgugcccgugcacugggucccgaccucccggaccaccuggagcauccacgcccaccaccaguggaugacgaccgaggacaugcugaccguguggaaccgcguguggaucgaggacaaccccuggauggaggacaagacccccgucacgaccugggagaacgugcccuaccucgggaagcgggaggaccaguggugcggcagccugaucgggcugaccucccgcgcgaccugggcccagaacaucccgacggccauccagcagguccggagccucaucggcaacgaggaguuccuggacuacaugcccuccaugaagcgcuuccggaaggaggaggagagcgagggggccaucugguga

SEQ ID NO: 9850 - RNA, 9873 nt, Artificial Sequence
  derived and/or modified CDS sequence (opt1) from DENV-3__KF041259__SS-prME
accagccugugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaacgagguggagcccgaggacaucgacugcuggugcaaccugacgagcaccugggugaccuacgggaccugcaaccaggccggcgagcaccggcgcgacaagcgguccguggcccucgcgccccacgugggcauggggcuggacacgcgcacccagaccuggaugagcgccgagggcgccuggcgccagguggagaagguggagaccugggcccugcgccacccgggguucacgauccucgcgcuguuccuggcccacuacaucggcaccucccucacccagaagguggugaucuucauccugcugaugcucgucacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggccacccagcuggcgacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggccagcacgaccgaggcgauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgccaagaagcaggaggucguggugcuggggucccaggagggcgcgaugcacaccgcccucaccggggccacggagauccagaacagcggcgggaccuccaucuucgccggccaccugaagugccggcugaagauggacaagcucgagcugaagggcaugagcuacgccaugugcaccaacaccuucguccugaagaaggagguguccgagacgcagcacgggaccauccucaucaagguggaguacaagggcgaggacgcgccgugcaagauccccuucagcaccgaggacgggcagggcaaggcccacaacggccgccugaucaccgccaaccccgucgugacgaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacaccgcccuguucagcggcguguccugggugaugaagaucggcaucgggguccuccugacguggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugaccaacgaggugcacacguggaccgagcaguacaaguuccaggccgacucccccaagcgccucgccaccgccaucgccggcgcgugggagaacggggucugcggcauccgcagcaccacgcggauggagaaccugcuguggaagcagaucgccaacgagcucaacuacauccugugggagaacaacaucaagcugaccgugguggucggggacaccaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagaugugcgaccaccggcugaugagcgccgccgugaaggacgagcgcgccgugcacgcggacaugggcuacuggaucgagagccagaagaacggguccuggaagcucgagaaggccagccugaucgaggucaagaccugcacguggccgaagucccacacccuguggagcaacggcgugcucgaguccgacaugaucauccccaagagccuggccgggcccaucucccagcacaacuaccggccgggcuaccacacccagaccgccgggcccuggcaccugggccgccucgagcuggacuucaacuacugcgagggcacgaccguggucaucaccgagaacugcgggacccggggccccagccugcgcacgaccaccguguccgggaagcucauccacgaguggugcugccggagcugcacccugcccccgcugcgcuacaugggcgaggacgggugcugguacggcauggagauccggcccaucuccgagaaggaggagaacauggucaagagccucgucuccgccggcagcgggaagguggacaacuucacgaugggcgugcugugccuggcgauccucuucgaggaggucaugcgcgggaaguucggcaagaagcacaugaucgccgggguguucuucaccuucgugcugcugcucuccggccagaucaccuggcgggacauggcccacacccugaucaugaucggcagcaacgccuccgaccgcauggggaugggcgucacguaccuggcccucaucgcgaccuucaagauccagcccuuccuggcccugggguucuuccuccggaagcugaccagccgcgagaaccugcuccugggcgugggccuggccauggccaccacgcuccagcugcccgaggacaucgagcagauggcgaacgggaucgcccugggccucauggcccugaagcugaucacccaguucgagaccuaccagcucuggaccgcccugaucagccugacgugcuccaacaccaucuucacccucaccguggccuggcggacggcgacccugauccuggccggggucagccuccugccggugugccaguccagcuccaugcgcaagaccgacuggcugcccaugaccgucgccgccaugggcgugccgccccucccgcuguucaucuucagccugaaggacacgcucaagcgccgguccuggccccugaacgagggggugauggccgucggccuggugagcauccucgcguccagccugcugcgcaacgacgugcccauggccggcccccucgucgccgggggccugcugaucgccugcuacgugaucaccgggaccuccgccgaccucaccguggagaaggcggccgacgucacgugggaggaggaggccgagcagaccggcgugagccacaaccugaugaucaccguggacgacgacgggaccaugcggaucaaggacgacgagaccgagaacauccugacgguccuccugaagaccgcccugcucaucguguccggcaucuucccguacagcauccccgccacccugcugguguggcacaccuggcagaagcagacgcagcgcuccggcguccucugggacgugcccagcccgcccgagacccagaaggcggagcuggaggaggggguguaccggaucaagcagcagggcauccuggggaagacccaggucggcgugggggugcagaaggagggcgucuuccacaccauguggcacgugacgcgcggcgccgugcucacccacaacgggaagcggcuggagcccaacugggccuccgucaagaaggaccugaucagcuacggcgggggcuggcgccucuccgcccaguggcagaagggggaggagguccaggugaucgcggucgagcccggcaagaaccccaagaacuuccagaccaugcccggcaccuuccagacgaccaccggggagaucggcgccaucgcccuggacuucaagcccgggaccagcggcagccccaucaucaaccgggagggcaaggugguggggcuguacggcaacggggucgugacgaagaacggcggguacguguccggcaucgcccagaccaacgccgagccggacggccccacccccgagcuggaggaggagauguucaagaagcgcaaccucaccaucauggaccugcaccccgggagcggcaagacgcggaaguaccugccggcgaucguccgcgaggccaucaagcggcgccuccggacccugauccuggcccccacccgcgugguggccgccgagauggaggaggcgcucaaggggcugcccauccgguaccagaccacggccaccaaguccgagcacaccggccgcgagaucgucgaccugaugugccacgccaccuucacgaugcggcuccugagccccgugcgcgugccgaacuacaaccugaucaucauggacgaggcccacuucaccgaccccgccuccaucgcggcccggggguacaucagcacccgcgucggcaugggcgaggccgccgcgaucuucaugaccgccacgccgcccgggaccgccgacgccuucccgcaguccaacgcccccauccaggacgaggagcgcgacauccccgagcggagcuggaacuccggcaacgaguggaucaccgacuucgcggggaagaccgugugguucgugcccagcaucaaggccggcaacgacaucgccaacugccuccgcaagaacgggaagaaggucauccagcugucccggaagacguucgacaccgaguaccagaagaccaagcugaacgacugggacuucguggugaccacggacaucagcgagaugggcgccaacuucaaggccgaccgcgucaucgacccgcggcgcugccucaagcccgugauccugaccgacggccccgagcgggugauccuggcggggcccaugccggucaccgccgccuccgccgcccagcgccggggccgcguggggcggaacccccagaaggagaacgaccaguacaucuucaccggccagccccucaacaacgacgaggaccacgcgcacuggaccgaggccaagaugcugcuggacaacaucaacacgcccgaggggaucaucccggcccucuucgagcccgagcgcgagaaguccgccgcgaucgacggcgaguaccggcugaagggcgagucccgcaagaccuucguggagcugaugcggcgcggggaccuccccgucuggcuggcccacaagguggccagcgagggcaucaaguacaccgaccggaaguggugcuucgacgggcagcgcaacaaccagauccuggaggagaacauggacgucgagaucuggaccaaggagggcgagaagcggaagcuccgcccccgcuggcuggacgcccggacguacuccgacccgcuggcccucaaggaguucaaggacuucgcggccggccgcaagagcaucgcccuggaccuggugaccgagaucgggcgggugcccucccaccucgcccaccgcacccggaacgcccuggacaaccuggucaugcuccacaccagcgagcacggcgggcgcgcguaccggcacgccguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucguccuggaguucuucaugauggugcuccugauccccgagcccgagaagcagcgcacgccccaggacaaccagcuggccuacguggucaucgggauccucacccuggccgccaucaucgcggccaacgagaugggccugcucgagaccaccaagcgggaccugggcauguccaaggagccggggguggugagccccacguccuaccuggacgucgaccuccaccccgccagcgccuggacccuguacgcgguggccaccaccgugaucacgcccaugcugcgccacaccaucgagaacuccaccgccaacgucagccucgccgccaucgcgaaccaggccguggugcugaugggccuggacaagggguggccgaucuccaagauggaccucggcgucccccugcuggcccucgggugcuacagccaggugaacccccugacccugacggccgccgugcuccugcugaucacccacuacgcgaucaucggccccggccuccaggccaaggccacccgggaggcccagaagcgcaccgccgcggggaucaugaagaacccgacggucgacggcaucaucaccaucgaccuggaccccgugaucuacgacuccaaguucgagaagcagcugggccaggugaugcuccugguccugugcgccgugcagcuccugcugaugcggaccagcugggcccucugcgaggcccugacccuggcgacgggccccaucaccacccucugggagggcucccccgggaaguucuggaacaccacgaucgccgugagcauggccaacaucuuccgcggcuccuaccuggccggggccggccuggcguucagcaucaugaaguccgucgggaccggcaagcggggcaccgggagccagggcgagacccucggggagaaguggaagaagaagcugaaccagcugagccgcaaggaguucgaccucuacaagaaguccggcaucaccgagguggaccggacggaggccaaggaggggcugaagcgcggcgagaccacccaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcgcggcuacacgaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccaccguggaggagagccggacgauccgcguccugaagaugguggagccguggcucaagaacaaccaguucugcaucaaggugcugaaccccuacaugcccgcggucaucgagcaccuggagcggcuccagcgcaagcacggcgggaugcuggugcggaacccccugucccgcaacagcacccacgagauguacuggaucuccaacggcaccgggaacaucgugagcuccgucaacauggugagccggcuccugcugaaccgcuucaagaugacccaccggcgcccgacgaucgagaaggacguggaccucggcgccggcacccggcacgucaacgccgagcccgagacccccaacauggacgugaucggggagcgcaucaagcggaucaaggaggagcacaacuccaccuggcacuacgacgacgagaacccguacaagacgugggccuaccacggcagcuacgaggugaaggccaccggguccgcgagcagcaugaucaacggcgucgugaagcugcugaccaagcccugggacgucgugcccauggugacccagauggccaugacggacaccacccccuucgggcagcagcgcgucuucaaggagaagguggacacccggacgccgcgccccaugcccggcacccggaaggugauggagaucaccgccgaguggcucuggcgcacccugggccggaacaagcgcccccgccugugcacgcgggaggaguucaccaagaagguccgcaccaacgccgcgaugggggccguguucaccgaggagaaccagugggacuccgccaaggccgccguggaggacgaggaguucuggaagcucgucgaccgggagcgcgagcugcacaagcugggcaagugcgggagcugcguguacaacaugaugggcaagcgggagaagaagcucggggaguucggcaaggcgaagggcucccgcgccaucugguacauguggcugggggcccgguaccuggaguucgaggcccucggcuuccugaacgaggaccacugguucagccgcgagaacuccuacagcgggguggagggcgaggggcugcacaagcucggcuacauccugcgggacaucuccaagaucccgggcggggccauguacgcggacgacacggccggcugggacacccgcaucaccgaggacgaccugcacaacgaggagaagaucacccagcagauggaccccgagcaccggcuccuggccaacgccaucuucaagcugacguaccagaacaaggucgugaaggugcagcgccccacccccaccgggaccgucauggacaucaucagccggaaggaccagcgcggcuccggccagguggggaccuacggccucaacacguucaccaacauggaggcccagcuggugcggcagauggagggggagggcguccugagcaaggcggaccucgagaacccgcaccuccccgagaagaagaucacccaguggcuggagaccaaggggguggagcgccucaagcggauggccaucuccggcgacgacugcguggucaagcccaucgacgaccgcuucgccaacgcccugcuggcccucaacgacaugggcaaggugcggaaggacaucccccaguggcagccgagcaagggguggcacgacuggcagcagguccccuucugcucccaccacuuccacgagcugaucaugaaggacggccgcaagcuggucgugcccugccggccccaggacgagcucaucgggcgcgcgcgcaucagccagggcgccggguggucccugcgggagacggccugccugggcaaggccuacgcgcagauguggagccucauguacuuccaccgccgggaccugcgccuggccuccaacgccaucugcagcgccgugccgguccacugggugcccaccucccggaccaccuggagcauccacgcccaccaccaguggaugacgaccgaggacaugcucaccguguggaaccgcgucuggaucgaggacaaccccuggauggaggacaagacccccgugacgaccugggagaacgugccguaccugggcaagcgggaggaccaguggugcgggagccugaucggccucaccucccgcgcgaccugggcccagaacauccccacggccauccagcagguccggagccugaucgggaacgaggaguuccuggacuacaugcccuccaugaagcgcuuccggaaggaggaggagcucgagggcgccaucugguga

SEQ ID NO: 9851 - RNA, 9873 nt, Artificial Sequence
  derived and/or modified CDS sequence (opt1) from DENV-3__KF041258__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgggacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaccaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcucaagcugcgcgaggucuacacccagaugugcgaccaccggcugaugagcgccgccgugaaggacgagcgcgccgugcacgcggacaugggcuacuggaucgagagccagaagaacggguccuggaagcucgagaaggccagccugaucgaggucaagacgugcaccuggccgaagucccacacccuguggagcaacggcgugcucgaguccgacaugaucauccccaagagccuggccgggcccaucucccagcacaacuaccggccgggcuaccacacccagacggccgggcccuggcaccugggcaagcucgagcuggacuucaacuacugcgagggcaccaccguggucaucaccgagaacugcgggacgcgcggccccagccugcggaccaccaccguguccgggaagcucauccacgaguggugcugccgcagcugcacgcugcccccgcugcgguacaugggcgaggacgggugcugguacggcauggagauccgccccaucuccgagaaggaggagaacauggucaagagccucgucuccgccggcagcgggaagguggacaacuucaccaugggcgugcugugccuggcgauccucuucgaggaggucaugcgggggaaguucggcaagaagcacaugaucgccgggguguucuucaccuucgugcugcugcucuccggccagaucaccuggcgcgacauggcccacacgcugaucaugaucggcagcaacgccuccgaccggauggggaugggcgucaccuaccuggcccucaucgcgaccuucaagauccagcccuuccuggcccugggguucuuccuccgcaagcugaccagccgggagaaccugcuccugggcgugggccuggccauggccacgacccuccagcugcccgaggacaucgagcagauggcgaacgggaucgcccugggccucauggcccugaagcugaugacccaguucgagaccuaccagcucuggacggcccugaucagccugaccugcuccaacaccaucuucacccucacgguggccuggcgcaccgcgacccugauccuggccggggucagccuccugccggugugccaguccagcuccaugcggaagaccgacuggcugcccaugacggucgccgccaugggcgugccgccccucccgcuguucaucuucagccugaaggacacccucaagcgccgcuccuggccccugaacgagggggugauggccgucggccuggugagcauccucgcguccagccugcugcggaacgacgugcccauggccggcccccucgucgccgggggccugcugaucgccugcuacgugaucaccgggaccuccgccgaccucacgguggagaaggcggccgacgucaccugggaggaggaggccgagcagaccggcgugagccacaaccugaugaucaccguggacgacgacgggaccaugcgcaucaaggacgacgagacggagaacauccugaccguccuccugaagaccgcccugcucaucguguccggcaucuucccguacagcauccccgccacccugcugguguggcacacguggcagaagcagacccagcgguccggcguccucugggacgugcccagcccgcccgagacccagaaggcggagcuggaggaggggguguaccgcaucaagcagcagggcauccuggggaagacccaggucggcgugggggugcagaaggagggcgucuuccacacgauguggcacgugacccggggcgccgugcucacccacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcacguuccagaccaccaccggggagaucggcgccaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucguccgggaggccaucaagcgccggcuccgcacccugauccuggcccccacccgggugguggccgccgagauggaggaggcgcucaaggggcugcccauccgcuaccagacgaccgccaccaaguccgagcacaccggccgggagaucgucgaccugaugugccacgccacguucaccaugcgccuccugagccccgugcgggugccgaacuacaaccugaucaucauggacgaggcccacuucaccgaccccgccuccaucgcggcccgcggguacaucagcacccgggucggcaugggcgaggccgccgcgaucuucaugacggccacgccgcccgggaccgccgacgccuucccgcaguccaacgcccccauccaggacgaggagcgcgacauccccgagcgcagcuggaacuccggcaacgaguggaucaccgacuucgcggggaagacggugugguucgugcccagcaucaaggccggcaacgacaucgccaacugccuccggaagaacgggaagaaggucauccagcugucccgcaagaccuucgacaccgaguaccagaagaccaagcugaacgacugggacuucguggugacgaccgacaucagcgagaugggcgccaacuucaaggccgaccgggucaucgacccgcgccggugccucaagcccgugauccugaccgacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgggagaaguccgccgcgaucgacggcgaguaccgccugaagggcgagucccggaagaccuucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggacgaaggagggcgagaagcgcaagcuccggccccgcuggcuggacgcccgcaccuacuccgacccgcuggcccucaaggaguucaaggacuucgcggccggccgcaagagcaucgcccuggaccuggugaccgagaucgggcgcgugcccucccaccucgcccaccggacccgcaacgcccuggacaaccuggucaugcuccacacgagcgagcacggcgggcgggcguaccgccacgccguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucguccuggaguucuucaugauggugcuccugauccccgagcccgagaagcagcggacgccccaggacaaccagcuggccuacguggucaucgggauccucacccuggccgccaucaucgcggccaacgagaugggccugcucgagaccacgaagcgcgaccugggcauguccaaggagccggggguggugagccccaccuccuaccuggacgucgaccuccaccccgccagcgccuggacccuguacgcgguggccaccacggugaucacccccaugcugcggcacaccaucgagaacuccaccgccaacgucagccucgccgccaucgcgaaccaggccguggugcugaugggccuggacaagggguggccgaucuccaagauggaccucggcgucccccugcuggcccucgggugcuacagccaggugaacccccugacgcugaccgccgccgugcuccugcugaucacccacuacgcgaucaucggccccggccuccaggccaaggccacccgcgaggcccagaagcggacggccgcggggaucaugaagaacccgaccgucgacggcaucaucaccaucgaccuggaccccgugaucuacgacuccaaguucgagaagcagcugggccaggugaugcuccugguccugugcgccgugcagcuccugcugaugcgcaccagcugggcccucugcgaggcccugacgcuggcgaccggccccaucaccacccucugggagggcucccccgggaaguucuggaacacgaccaucgccgugagcauggccaacaucuuccggggcuccuaccuggccggggccggccuggcguucagcaucaugaaguccgucgggaccggcaagcgcggcaccgggagccagggcgagacccucggggagaaguggaagaagaagcugaaccagcugagccggaaggaguucgaccucuacaagaaguccggcaucacggagguggaccgcaccgaggccaaggaggggcugaagcggggcgagaccacccaccacgccgugagccgcggcuccgccaagcugcagugguucgucgagcggaacauggugaucccggaggggcgcgugaucgaccucggcugcgggcggggcggguggagcuacuacugcgccggccugaagaaggucacggaggugcgcggcuacaccaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccacgguggaggagagccgcaccauccggguccugaagaugguggagccguggcucaagaacaaccaguucugcaucaaggugcugaaccccuacaugcccgcggucaucgagcaccuggagcgccuccagcggaagcacggcgggaugcuggugcgcaacccccugucccggaacagcacccacgagauguacuggaucuccaacggcaccgggaacaucgugagcuccgucaacauggugagccgccuccugcugaaccgguucacgaugacccaccgccggccgaccaucgagaaggacguggaccucggcgccggcacccgccacgucaacgccgagcccgagacgcccaacauggacgugaucggggagcggaucaagcgcaucaaggaggagcacaacuccaccuggcacuacgacgacgagaacccguacaagaccugggccuaccacggcagcuacgaggugaaggccaccggguccgcgagcagcaugaucaacggcgucgugaagcugcugacgaagcccugggacgucgugcccauggugacccagauggccaugaccgacaccacgcccuucgggcagcagcgggucuucaaggagaagguggacacccgcaccccgcggcccaugcccggcacccgcaaggugauggagaucacggccgaguggcucuggcggacccugggccgcaacaagcggccccgccugugcacccgcgaggaguucaccaagaagguccggacgaacgccgcgaugggggccguguucaccgaggagaaccagugggacuccgccaaggccgccguggaggacgaggaguucuggaagcucgucgaccgcgagcgggagcugcacaagcugggcaagugcgggagcugcguguacaacaugaugggcaagcgcgagaagaagcucggggaguucggcaaggcgaagggcucccgggccaucugguacauguggcugggggcccgcuaccuggaguucgaggcccucggcuuccugaacgaggaccacugguucagccgggagaacuccuacagcgggguggagggcgaggggcugcacaagcucggcuacguccugcgcgacaucuccaagaucccgggcggggccauguacgcggacgacaccgccggcugggacacccggaucacggaggacgaccugcacaacgaggagaagaucacccagcagauggaccccgagcaccgccuccuggccaacgccaucuucaagcugaccuaccagaacaagguggugaagguccagcggcccacccccaccgggacggugauggacaucaucagccgcaaggaccagcggggcuccggccagguggggaccuacggccucaacaccuucaccaacauggaggcccagcugguccgccagauggagggggagggcgugcugagcaaggcggaccucgagaacccgcaccuccccgagaagaagaucacgcaguggcuggagaccaaggggguggagcggcucaagcgcauggccaucuccggcgacgacugcgucgugaagcccaucgacgaccgguucgccaacgcccugcuggcccucaacgacaugggcaaggugcgcaaggacaucccccaguggcagccgagcaagggguggcacgacuggcagcagguccccuucugcucccaccacuuccacgagcugaucaugaaggacggccggaagcugguggugcccugccgcccccaggacgagcucaucgggcgggcgcgcaucagccagggcgccggguggucccugcgcgagaccgccugccugggcaaggccuacgcgcagauguggagccucauguacuuccaccggcgcgaccugcggcuggccuccaacgccaucugcagcgccgucccggugcacugggugcccaccucccgcacgaccuggagcauccacgcccaccaccaguggaugaccaccgaggacaugcucacggucuggaaccggguguggaucgaggacaaccccuggauggaggacaagacccccgugaccaccugggagaacgucccguaccugggcaagcgcgaggaccaguggugcgggagccugaucggccucacgucccgggcgaccugggcccagaacauccccaccgccauccagcagguccgcagccugaucgggaacgaggaguuccuggacuacaugcccuccaugaagcgguuccgcaaggaggaggagcucgagggcgccaucugguga

SEQ ID NO: 9852 - RNA, 9873 nt, Artificial Sequence
  derived and/or modified CDS sequence (opt1) from DENV-3__KF041257__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgggacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaccaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcucaagcugcgcgaggucuacacccagaugugcgaccaccggcugaugagcgccgccgugaaggacgagcgcgccgugcacgcggacaugggcuacuggaucgagagccagaagaacggguccuggaagcucgagaaggccagccugaucgaggucaagacgugcaccuggccgaagucccacacccuguggagcaacggcgugcucgaguccgacaugaucauccccaagagccuggccgggcccaucucccagcacaacuaccggccgggcuaccacacccagacggccgggcccuggcaccugggcaagcucgagcuggacuucaacuacugcgagggcaccaccguggucaucaccgagaacugcgggacgcgcggccccagccugcggaccaccaccguguccgggaagcucauccacgaguggugcugccgcagcugcacgcugcccccgcugcgguacaugggcgaggacgggugcugguacggcauggagauccgccccaucuccgagaaggaggagaacauggucaagagccucgucuccgccggcagcgggaagguggacaacuucaccaugggcgugcugugccuggcgauccucuucgaggaggucaugcgggggaaguucggcaagaagcacaugaucgccgggguguucuucaccuucgugcugcugcucuccggccagaucaccuggcgcgacauggcccacacgcugaucaugaucggcagcaacgccuccgaccggauggggaugggcgucaccuaccuggcccucaucgcgaccuucaagauccagcccuuccuggcccugggguucuuccuccgcaagcugaccagccgggagaaccugcuccugggcgugggccuggccauggccacgacccuccagcugcccgaggacaucgagcagauggcgaacgggaucgcccugggccucauggcccugaagcugaucacccaguucgagaccuaccagcucuggacggcccugaucagccugaccugcuccaacaccaucuucacccucacgguggccuggcgcaccgcgacccugauccuggccggggucagccuccugccggugugccaguccagcuccaugcggaagaccgacuggcugcccaugacggucgccgccaugggcgugccgccccucccgcuguucaucuucagccugaaggacacccucaagcgccgcuccuggccccugaacgagggggugauggccgucggccuggugagcauccucgcguccagccugcugcggaacgacgugcccauggccggcccccucgucgccgggggccugcugaucgccugcuacgugaucaccgggaccuccgccgaccucacgguggagaaggcggccgacgucaccugggaggaggaggccgagcagaccggcgugagccacaaccugaugaucaccguggacgacgacgggaccaugcgcaucaaggacgacgagacggagaacauccugaccguccuccugaagaccgcccugcucaucguguccggcaucuucccguacagcauccccgccacccugcugguguggcacacguggcagaagcagacccagcgguccggcguccucugggacgugcccagcccgcccgagacccagaaggcggagcuggaggaggggguguaccgcaucaagcagcagggcauccuggggaagacccaggucggcgugggggugcagaaggagggcgucuuccacacgauguggcacgugacccggggcgccgugcucacccacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcacguuccagaccaccaccggggagaucggcgccaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucguccgggaggccaucaagcgccggcuccgcacccugauccuggcccccacccgggugguggccgccgagauggaggaggcgcucaaggggcugcccauccgcuaccagacgaccgccaccaaguccgagcacaccggccgggagaucgucgaccugaugugccacgccacguucaccaugcgccuccugagccccgugcgggugccgaacuacaaccugaucaucauggacgaggcccacuucaccgaccccgccuccaucgcggcccgcggguacaucagcacccgggucggcaugggcgaggccgccgcgaucuucaugacggccacgccgcccgggaccgccgacgccuucccgcaguccaacgcccccauccaggacgaggagcgcgacauccccgagcgcagcuggaacuccggcaacgaguggaucaccgacuucgcggggaagacggugugguucgugcccagcaucaaggccggcaacgacaucgccaacugccuccggaagaacgggaagaaggucauccagcugucccgcaagaccuucgacaccgaguaccagaagaccaagcugaacgacugggacuucguggugacgaccgacaucagcgagaugggcgccaacuucaaggccgaccgggucaucgacccgcgccggugccucaagcccgugauccugaccgacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgggagaaguccgccgcgaucgacggcgaguaccgccugaagggcgagucccggaagaccuucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggacgaaggagggcgagaagcgcaagcuccggccccgcuggcuggacgcccgcaccuacuccgacccgcuggcccucaaggaguucaaggacuucgcggccggccgcaagagcaucgcccuggaccuggugaccgagaucgggcgcgugcccucccaccucgcccaccggacccgcaacgcccuggacaaccuggucaugcuccacacgagcgagcacggcgggcgggcguaccgccacgccguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucguccuggaguucuucaugauggugcuccugauccccgagcccgagaagcagcggacgccccaggacaaccagcuggccuacguggucaucgggauccucacccuggccgccaucaucgcggccaacgagaugggccugcucgagaccacgaagcgcgaccugggcauguccaaggagccggggguggugagccccaccuccuaccuggacgucgaccuccaccccgccagcgccuggacccuguacgcgguggccaccacggugaucacccccaugcugcggcacaccaucgagaacuccaccgccaacgucagccucgccgccaucgcgaaccaggccguggugcugaugggccuggacaagggguggccgaucuccaagauggaccucggcgucccccugcuggcccucgggugcuacagccaggugaacccccugacgcugaccgccgccgugcuccugcugaucacccacuacgcgaucaucggccccggccuccaggccaaggccacccgcgaggcccagaagcggacggccgcggggaucaugaagaacccgaccgucgacggcaucaucaccaucgaccuggaccccgugaucuacgacuccaaguucgagaagcagcugggccaggugaugcuccugguccugugcgccgugcagcuccugcugaugcgcaccagcugggcccucugcgaggcccugacgcuggcgaccggccccaucaccacccucugggagggcucccccgggaaguucuggaacacgaccaucgccgugagcauggccaacaucuuccggggcuccuaccuggccggggccggccuggcguucagcaucaugaaguccgucgggaccggcaagcgcggcaccgggagccagggcgagacccuccgggagaaguggaagaagaagcugaaccagcugagccgcaaggaguucgaccucuacaagaaguccgggaucacggagguggaccggaccgaggccaaggagggccugaagcgcggggagaccacccaccacgccgugagccggggcuccgccaagcugcagugguucgucgagcgcaacauggugaucccggagggccgggugaucgaccucgggugcggccgcgggggcuggagcuacuacugcgccgggcugaagaaggucacggaggugcgcggcuacaccaagggcgggcccggccacgaggagcccgugcccauguccaccuacggguggaacaucgucaagcugaugagcggcaaggacguguucuaccucccgcccgagaagugcgacacccugcugugcgacaucggggaguccagccccucccccacgguggaggagagccggaccauccgcguccugaagaugguggagccguggcucaagaacaaccaguucugcaucaaggugcugaaccccuacaugcccgcggucaucgagcaccuggagcggcuccagcgcaagcacggcggcaugcuggugcggaacccccugucccgcaacagcacccacgagauguacuggaucuccaacgggaccggcaacaucgugagcuccgucaacauggugagccggcuccugcugaaccgcuucacgaugacccaccggcgcccgaccaucgagaaggacguggaccucggggccggcacccggcacgucaacgccgagcccgagacgcccaacauggacgugaucggcgagcgcaucaagcggaucaaggaggagcacaacuccaccuggcacuacgacgacgagaacccguacaagaccugggccuaccacgggagcuacgaggugaaggccaccggcuccgcgagcagcaugaucaacggggucgugaagcugcugacgaagcccugggacgucgugcccauggugacccagauggccaugaccgacaccacgcccuucggccagcagcgcgucuucaaggagaagguggacacccggaccccgcgccccaugcccgggacccggaaggugauggagaucacggccgaguggcucuggcgcacccugggccggaacaagcgcccccgccugugcacccgggaggaguucaccaagaagguccgcacgaacgccgcgaugggcgccguguucaccgaggagaaccagugggacuccgccaaggccgccguggaggacgaggaguucuggaagcucgucgaccgggagcgcgagcugcacaagcuggggaagugcggcagcugcguguacaacaugauggggaagcgggagaagaagcucggcgaguucgggaaggcgaagggcucccgcgccaucugguacauguggcugggcgcccgguaccuggaguucgaggcccucggguuccugaacgaggaccacugguucagccgcgagaacuccuacagcggcguggagggggagggccugcacaagcucggguacauccugcgggacaucuccaagaucccgggcggcgccauguacgcggacgacaccgccgggugggacacccgcaucacggaggacgaccugcacaacgaggagaagaucacccagcagauggaccccgagcaccggcuccuggccaacgccaucuucaagcugaccuaccagaacaaggucgugaaggugcagcgccccacccccaccggcacggucauggacaucaucagccggaaggaccagcgcggguccggccaggugggcaccuacgggcucaacaccuucaccaacauggaggcccagcuggugcggcagauggagggcgaggggguccugagcaaggcggaccucgagaacccgcaccuccccgagaagaagaucacgcaguggcuggagaccaagggcguggagcgccucaagcggauggccaucuccggggacgacugcguggucaagcccaucgacgaccgcuucgccaacgcccugcuggcccucaacgacaugggcaaggugcggaaggacaucccccaguggcagccgagcaagggcuggcacgacuggcagcagguccccuucugcucccaccacuuccacgagcugaucaugaaggacgggcgcaagcuggucgugcccugccggccccaggacgagcucaucggccgcgcgcgcaucagccagggggccggcuggucccugcgggagaccgccugccuggggaaggccuacgcgcagauguggagccucauguacuuccaccgccgggaccugcgccuggccuccaacgccaucugcagcgccgugccgguccacugggugcccaccucccggacgaccuggagcauccacgcccaccaccaguggaugaccaccgaggacaugcucacgguguggaaccgcgucuggaucgaggacaaccccuggauggaggacaagacccccgugaccaccugggagaacgugccguaccugggcaagcgggaggaccaguggugcggcagccugaucgggcucacgucccgcgcgaccugggcccagaacauccccaccgccauccagcagguccggagccugaucggcaacgaggaguuccuggacuacaugcccuccaugaagcgcuuccggaaggaggaggagcucgagggggccaucugguga

SEQ ID NO: 9853 - RNA, 9873 nt, Artificial Sequence
  derived and/or modified CDS sequence (opt1) from DENV-3__KF041255__SS-prME
accagccugugccucaugaugauccugcccgccgcccuggcguuccaccucaccagccggaacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgggacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaccaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcucaagcugcgcgaggucuacacccagaugugcgaccaccggcugaugagcgccgccgugaaggacgagcgcgccgugcacgcggacaugggcuacuggaucgagagccagaagaacggguccuggaagcucgagaaggccagccugaucgaggucaagacgugcaccuggccgaagucccacacccuguggagcaacggcgugcucgaguccgacaugaucauccccaagagccuggccgggcccaucucccagcacaacuaccggccgggcuaccacacccagacggccgggcccuggcaccugggcaagcucgagcuggacuucaacuacugcgagggcaccaccguggucaucaccgagaacugcgggacgcgcggccccagccugcggaccaccaccguguccgggaagcucauccacgaguggugcugccgcagcugcacgcugcccccgcugcgguacaugggcgaggacgggugcugguacggcauggagauccgccccaucuccgagaaggaggagaacauggucaagagccucgucuccgccggcagcgggaagguggacaacuucaccaugggcgugcugugccuggcgauccucuucgaggaggucaugcgggggaaguucggcaagaagcacaugaucgccgggguguucuucaccuucgugcugcugcucuccggccagaucaccuggcgcgacauggcccacacgcugaucaugaucggcagcaacgccuccgaccggauggggaugggcgucaccuaccuggcccucaucgcgaccuucaagauccagcccuuccuggcccugggguucuuccuccgcaagcugaccagccgggagaaccugcuccugggcgugggccuggccauggccacgacccuccagcugcccgaggacaucgagcagauggcgaacgggaucgcccugggccucauggcccugaagcugaucacccaguucgagaccuaccagcucuggacggcccugaucagccugaccugcuccaacaccaucuucacccucacgguggccuggcgcaccgcgacccugauccuggccggggucagccuccugccggugugccaguccagcuccaugcggaagaccgacuggcugcccaugacggucgccgccaugggcgugccgccccucccgcuguucaucuucagccugaaggacacccucaagcgccgcuccuggccccugaacgagggggugauggccgucggccuggugagcauccucgcguccagccugcugcggaacgacgugcccauggccggcccccucgucgccgggggccugcugaucgccugcuacgugaucaccgggaccuccgccgaccucacgguggagaaggcggccgacgucaccugggaggaggaggccgagcagaccggcgugagccacaaccugaugaucaccguggacgacgacgggaccaugcgcaucaaggacgacgagacggagaacauccugaccguccuccugaagaccgcccugcucaucguguccggcaucuucccguacagcauccccgccacccugcugguguggcacacguggcagaagcagacccagcgguccggcguccucugggacgugcccagcccgcccgagacccagaaggcggagcuggaggaggggguguaccgcaucaagcagcagggcauccuggggaagacccaggucggcgugggggugcagaaggagggcgucuuccacacgauguggcacgugacccggggcgccgugcucacccacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcacguuccagaccaccaccggggagaucggcgccaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucguccgggaggccaucaagcgccggcuccgcacccugauccuggcccccacccgggugguggccgccgagauggaggaggcgcucaaggggcugcccauccgcuaccagacgaccgccaccaaguccgagcacaccggccgggagaucgucgaccugaugugccacgccacguucaccaugcgccuccugagccccgugcgggugccgaacuacaaccugaucaucauggacgaggcccacuucaccgaccccgccuccaucgcggcccgcggguacaucagcacccgggucggcaugggcgaggccgccgcgaucuucaugacggccacgccgcccgggaccgccgacgccuucccgcaguccaacgcccccauccaggacgaggagcgcgacauccccgagcgcagcuggaacuccggcaacgaguggaucaccgacuucgcggggaagacggugugguucgugcccagcaucaaggccggcaacgacaucgccaacugccuccggaagaacgggaagaaggucauccagcugucccgcaagaccuucgacaccgaguaccagaagaccaagcugaacgacugggacuucguggugacgaccgacaucagcgagaugggcgccaacuucaaggccgaccgggucaucgacccgcgccggugccucaagcccgugauccugaccgacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgggagaaguccgccgcgaucgacggcgaguaccgccugaagggcgagucccggaagaccuucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggacgaaggagggcgagaagcgcaagcuccggccccgcuggcuggacgcccgcaccuacuccgacccgcuggcccucaaggaguucaaggacuucgcggccggccgcaagagcaucgcccuggaccuggugaccgagaucgggcgcgugcccucccaccucgcccaccggacccgcaacgcccuggacaaccuggucaugcuccacacgagcgagcacggcgggcgggcguaccgccacgccguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucguccuggaguucuucaugauggugcuccugauccccgagcccgagaagcagcggacgccccaggacaaccagcuggccuacguggucaucgggauccucacccuggccgccaucaucgcggccaacgagaugggccugcucgagaccacgaagcgcgaccugggcauguccaaggagccggggguggugagccccaccuccuaccuggacgucgaccuccaccccgccagcgccuggacccuguacgcgguggccaccacggugaucacccccaugcugcggcacaccaucgagaacuccaccgccaacgucagccucgccgccaucgcgaaccaggccguggugcugaugggccuggacaagggguggccgaucuccaagauggaccucggcgucccccugcuggcccucgggugcuacagccaggugaacccccugacgcugaccgccgccgugcuccugcugaucacccacuacgcgaucaucggccccggccuccaggccaaggccacccgcgaggcccagaagcggacggccgcggggaucaugaagaacccgaccgucgacggcaucaucaccaucgaccuggaccccgugaucuacgacuccaaguucgagaagcagcugggccaggugaugcuccugguccugugcgccgugcagcuccugcugaugcgcaccagcugggcccucugcgaggcccugacgcuggcgaccggccccaucaccacccucugggagggcucccccgggaaguucuggaacacgaccaucgccgugagcauggccaacaucuuccggggcuccuaccuggccggggccggccuggcguucagcaucaugaaguccgucgggaccggcaagcgcggcaccgggagccagggcgagacccucggggagaaguggaagaagaagcugaaccagcugagccggaaggaguucgaccucuacaagaaguccggcaucacggagguggaccgcaccgaggccaaggaggggcugaagcggggcgagaccacccaccacgccgugagccgcggcuccgccaagcugcagugguucgucgagcggaacauggugaucccggaggggcgcgugaucgaccucggcugcgggcggggcggguggagcuacuacugcgccggccugaagaaggucacggaggugcgcggcuacaccaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccacgguggaggagagccgcaccauccggguccugaagaugguggagccguggcucaagaacaaccaguucugcaucaaggugcugaaccccuacaugcccgcggucaucgagcaccuggagcgccuccagcggaagcacggcgggaugcuggugcgcaacccccugucccggaacagcacccacgagauguacuggaucuccaacggcaccgggaacaucgugagcuccgucaacauggugagccgccuccugcugaaccgguucaagaugacgcaccgccggccgaccaucgagaaggacguggaccucggcgccggcacccgccacgucaacgccgagcccgagacccccaacauggacgugaucggggagcggaucaagcgcaucaaggaggagcacaacuccacguggcacuacgacgacgagaacccguacaagaccugggccuaccacggcagcuacgaggugaaggccaccggguccgcgagcagcaugaucaacggcgucgugaagcugcugaccaagcccugggacgucgugcccauggugacgcagauggccaugaccgacaccacccccuucgggcagcagcgggucuucaaggagaagguggacacgcgcaccccgcggcccaugcccggcacccgcaaggugauggagaucaccgccgaguggcucuggcggacgcugggccgcaacaagcggccccgccugugcacccgcgaggaguucaccaagaagguccggaccaacgccgcgaugggggccguguucacggaggagaaccagugggacuccgccaaggccgccguggaggacgaggaguucuggaagcucgucgaccgcgagcgggagcugcacaagcugggcaagugcgggagcugcguguacaacaugaugggcaagcgcgagaagaagcucggggaguucggcaaggcgaagggcucccgggccaucugguacauguggcugggggcccgcuaccuggaguucgaggcccucggcuuccugaacgaggaccacugguucagccgggagaacuccuacagcgggguggagggcgaggggcugcacaagcucggcuacauccugcgcgacaucuccaagaucccgggcggggccauguacgcggacgacaccgccggcugggacacccggaucaccgaggacgaccugcacaacgaggagaagaucacgcagcagauggaccccgagcaccgccuccuggccaacgccaucuucaagcugaccuaccagaacaaggucgugaaggugcagcggcccacccccaccgggaccgucauggacaucaucagccgcaaggaccagcggggcuccggccagguggggacguacggccucaacaccuucaccaacauggaggcccagcuggugcgccagauggagggggagggcguccugagcaaggcggaccucgagaacccgcaccuccccgagaagaagaucacccaguggcuggagacgaaggggguggagcggcucaagcgcauggccaucuccggcgacgacugcguggucaagcccaucgacgaccgguucgccaacgcccugcuggcccucaacgacaugggcaaggugcgcaaggacaucccccaguggcagccgagcaagggguggcacgacuggcagcagguccccuucugcucccaccacuuccacgagcugaucaugaaggacggccggaagcuggucgugcccugccgcccccaggacgagcucaucgggcgggcgcgcaucagccagggcgccggguggucccugcgcgagaccgccugccugggcaaggccuacgcgcagauguggagccucauguacuuccaccggcgcgaccugcggcuggccuccaacgccaucugcagcgccgugccgguccacugggugcccaccucccgcaccacguggagcauccacgcccaccaccaguggaugaccaccgaggacaugcucaccguguggaaccgggucuggaucgaggacaaccccuggauggaggacaagacgcccgugaccaccugggagaacgugccguaccugggcaagcgcgaggaccaguggugcgggagccugaucggccucaccucccgggcgacgugggcccagaacauccccaccgccauccagcagguccgcagccugaucgggaacgaggaguuccuggacuacaugcccuccaugaagcgguuccgcaaggaggaggagcucgagggcgccaucugguga

SEQ ID NO: 9854 - RNA, 9873 nt, Artificial Sequence
  derived and/or modified CDS sequence (opt1) from DENV-3__KF041256__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgggacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgugacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaccaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcucaagcugcgcgaggucuacacccagaugugcgaccaccggcugaugagcgccgccgugaaggacgagcgcgccgugcacgcggacaugggcuacuggaucgagagccagaagaacggguccuggaagcucgagaaggccagccugaucgaggucaagacgugcaccuggccgaagucccacacccuguggagcaacggcgugcucgaguccgacaugaucauccccaagagccuggccgggcccaucucccagcacaacuaccggccgggcuaccacacccagacggccgggcccuggcaccugggcaagcucgagcuggacuucaacuacugcgagggcaccaccguggucaucaccgagaacugcgggacgcgcggccccagccugcggaccaccaccguguccgggaagcucauccacgaguggugcugccgcagcugcacgcugcccccgcugcgguacaugggcgaggacgggugcugguacggcauggagauccgccccaucuccgagaaggaggagaacauggucaagagccucgucuccgccggcagcgggaagguggacaacuucaccaugggcgugcugugccuggcgauccucuucgaggaggucaugcgggggaaguucggcaagaagcacaugaucgccgggguguucuucaccuucgugcugcugcucuccggccagaucaccuggcgcgacauggcccacacgcugaucaugaucggcagcaacgccuccgaccggauggggaugggcgucaccuaccuggcccucaucgcgaccuucaagauccagcccuuccuggcccugggguucuuccuccgcaagcugaccagccgggagaaccugcuccugggcgugggccuggccauggccacgacccuccagcugcccgaggacaucgagcagauggcgaacgggaucgcccugggccucauggcccugaagcugaucacccaguucgagaccuaccagcucuggacggcccugaucagccugaccugcuccaacaccaucuucacccucacgguggccuggcgcaccgcgacccugauccuggccggggucagccuccugccggugugccaguccagcuccaugcggaagaccgacuggcugcccaugacggucgccgccaugggcgugccgccccugccgcuguucaucuucagccugaaggacacccucaagcgccgcuccuggccccugaacgagggggugauggccgucggccuggugagcauccucgcguccagccugcugcggaacgacgugcccauggccggcccccucgucgccgggggccugcugaucgccugcuacgugaucaccgggaccuccgccgaccucacgguggagaaggcggccgacgucaccugggaggaggaggccgagcagaccggcgugagccacaaccugaugaucaccguggacgacgacgggaccaugcgcaucaaggacgacgagacggagaacauccugaccguccuccugaagaccgcccugcucaucguguccggcaucuucccguacagcauccccgccacccugcugguguggcacacguggcagaagcagacccagcgguccggcguccucugggacgugcccagcccgcccgagacccagaaggcggagcuggaggaggggguguaccgcaucaagcagcagggcauccuggggaagacccaggucggcgugggggugcagaaggagggcgucuuccacacgauguggcacgugacccggggcgccgugcucacccacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcacguuccagaccaccaccggggagaucggcgccaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucguccgggaggccaucaagcgccggcuccgcacccugauccuggcccccacccgggugguggccgccgagauggaggaggcgcucaaggggcugcccauccgcuaccagacgaccgccaccaaguccgagcacaccggccgggagaucgucgaccugaugugccacgccacgcucaccaugcgccugcugagccccgugcgggugccgaacuacaaccucaucaucauggacgaggcccacuucaccgaccccgccuccaucgcggcccgcggguacaucagcacccgggucggcaugggcgaggccgccgcgaucuucaugacggccacgccgcccgggaccgccgacgccuucccgcaguccaacgcccccauccaggacgaggagcgcgacauccccgagcgcagcuggaacuccggcaacgaguggaucaccgacuucgcggggaagacggugugguucgugcccagcaucaaggccggcaacgacaucgccaacugccugcggaagaacgggaagaaggucauccagcugucccgcaagaccuucgacaccgaguaccagaagaccaagcucaacgacugggacuucguggugacgaccgacaucagcgagaugggcgccaacuucaaggccgaccgggucaucgacccgcgccggugccugaagcccgugauccugaccgacggccccgagcgcgugauccucgcggggcccaugccggucaccgccgccuccgccgcccagcggcgcggccggguggggcgcaacccccagaaggagaacgaccaguacaucuucaccggccagccccugaacaacgacgaggaccacgcgcacuggacggaggccaagaugcugcucgacaacaucaacacccccgaggggaucaucccggcccuguucgagcccgagcgggagaaguccgccgcgaucgacggcgaguaccgccugaagggcgagucccggaagaccuucguggagcucaugcgccgcggggaccugcccgucuggcuggcccacaagguggccagcgagggcaucaaguacaccgaccgcaaguggugcuucgacgggcagcggaacaaccagauccucgaggagaacauggacgucgagaucuggacgaaggagggcgagaagcgcaagcugcggccccgcuggcuggacgcccgcaccuacuccgacccgcucgcccugaaggaguucaaggacuucgcggccggccgcaagagcaucgcccuggaccucgugaccgagaucgggcgcgugcccucccaccuggcccaccggacccgcaacgcccuggacaaccucgucaugcugcacacgagcgagcacggcgggcgggcguaccgccacgccguggaggagcugcccgagaccauggagacccuccugcugcucggccugaugauccugcucaccgggggcgccaugcuguuccugaucagcggcaaggggaucggcaagacguccaucgggcucaucugcgugaucgccagcuccggcaugcuguggauggccgagaucccgcugcaguggaucgcgagcgccaucguccucgaguucuucaugauggugcugcugauccccgagcccgagaagcagcggacgccccaggacaaccagcucgccuacguggucaucgggauccugacccuggccgccaucaucgcggccaacgagaugggccuccuggagaccacgaagcgcgaccugggcauguccaaggagccggggguggugagccccaccuccuaccucgacgucgaccugcaccccgccagcgccuggacccuguacgcgguggccaccacggugaucacccccaugcuccggcacaccaucgagaacuccaccgccaacgucagccuggccgccaucgcgaaccaggccguggugcugaugggccucgacaagggguggccgaucuccaagauggaccugggcgucccccugcucgcccuggggugcuacagccaggugaacccccugacgcucaccgccgccgugcugcugcucaucacccacuacgcgaucaucggccccggccugcaggccaaggccacccgcgaggcccagaagcggacggccgcggggaucaugaagaacccgaccgucgacggcaucaucaccaucgaccuggaccccgugaucuacgacuccaaguucgagaagcagcucggccaggugaugcugcugguccucugcgccgugcagcugcugcucaugcgcaccagcugggcccugugcgaggcccugacgcucgcgaccggccccaucaccacccugugggagggcucccccgggaaguucuggaacacgaccaucgccgugagcauggccaacaucuuccggggcuccuaccuggccggggccggccucgcguucagcaucaugaaguccgucgggaccggcaagcgcggcaccgggagccagggcgagacccugggggagaaguggaagaagaagcugaaccagcucagccggaaggaguucgaccuguacaagaaguccggcaucacggagguggaccgcaccgaggccaaggaggggcugaagcggggcgagaccacccaccacgccgugagccgcggcuccgccaagcuccagugguucgucgagcggaacauggugaucccggaggggcgcgugaucgaccugggcugcgggcggggcggguggagcuacuacugcgccggccugaagaaggucacggaggugcgcggcuacaccaagggcgggcccgggcacgagaagcccgugcccauguccaccuacggcuggaacaucgucaagcucaugagcgggaaggacguguucuaccugccgcccgagaagugcgacacccugcugugcgacaucggcgaguccagccccucccccacgguggaggagagccgcaccauccggguccucaagaugguggagccguggcugaagaacaaccaguucugcaucaaggugcugaaccccuacaugcccgcggucaucgagcaccucgagcgccugcagcggaagcacggcgggaugcuggugcgcaacccccucucccggaacagcacccacgagauguacuggaucuccaacggcaccgggaacaucgugagcuccgucaacauggugagccgccugcugcucaaccgguucaagaugacgcaccgccggccgaccaucgagaaggacguggaccugggcgccggcacccgccacgucaacgccgagcccgagacccccaacauggacgugaucggggagcggaucaagcgcaucaaggaggagcacaacuccacguggcacuacgacgacgagaacccguacaagaccugggccuaccacggcagcuacgaggugaaggccaccggguccgcgagcagcaugaucaacggcgucgugaagcugcucaccaagcccugggacgucgugcccauggugacgcagauggccaugaccgacaccacccccuucgggcagcagcgggucuucaaggagaagguggacacgcgcaccccgcggcccaugcccggcacccgcaaggugauggagaucaccgccgaguggcuguggcggacgcugggccgcaacaagcggccccgccucugcacccgcgaggaguucaccaagaagguccggaccaacgccgcgaugggggccguguucacggaggagaaccagugggacuccgccaaggccgccguggaggacgaggaguucuggaagcuggucgaccgcgagcgggagcugcacaagcucggcaagugcgggagcugcguguacaacaugaugggcaagcgcgagaagaagcugggggaguucggcaaggcgaagggcucccgggccaucugguacauguggcugggggcccgcuaccucgaguucgaggcccugggcuuccugaacgaggaccacugguucagccgggagaacuccuacagcgggguggagggcgaggggcuccacaagcugggcuacauccugcgcgacaucuccaagaucccgggcggggccauguacgcggacgacaccgccggcugggacacccggaucaccgaggacgaccuccacaacgaggagaagaucacgcagcagauggaccccgagcaccgccugcuggccaacgccaucuucaagcucaccuaccagaacaaggucgugaaggugcagcggcccacccccaccgggaccgucauggacaucaucagccgcaaggaccagcggggcuccggccagguggggacguacggccugaacaccuucaccaacauggaggcccagcuggugcgccagauggagggggagggcguccucagcaaggcggaccuggagaacccgcaccuccccgagaagaagaucacccaguggcucgagacgaaggggguggagcggcugaagcgcauggccaucuccggcgacgacugcguggucaagcccaucgacgaccgguucgccaacgcccugcucgcccugaacgacaugggcaaggugcgcaaggacaucccccaguggcagccgagcaagggguggcacgacuggcagcagguccccuucugcucccaccacuuccacgagcugaucaugaaggacggccggaagcucgucgugcccugccgcccccaggacgagcugaucgggcgggcgcgcaucagccagggcgccggguggucccugcgcgagaccgccugccucggcaaggccuacgcgcagauguggagccugauguacuuccaccggcgcgaccugcggcucgccuccaacgccaucugcagcgccgugccgauccacuggguccccaccucccgcaccacguggagcauccacgcccaccaccaguggaugaccaccgaggacaugcugaccguguggaaccggguguggaucgaggacaaccccuggauggaggacaagacgcccgucaccaccugggagaacgugccguaccugggcaagcgcgaggaccaguggugcgggagccucaucggccugaccucccgggcgacgugggcccagaacauccccaccgccauccagcagguccgcagccugaucgggaacgaggaguuccucgacuacaugcccuccaugaagcgguuccgcaaggaggaggagcuggagggcgccaucugguga

SEQ ID NO: 9855 - RNA, 9873 nt, Artificial Sequence
  derived and/or modified CDS sequence (opt1) from DENV-3__KF041254__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcguggugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggcggaccugggggaaggccaagaucgucaccgccgagacgcagaacagcuccuucaucaucgacggccccaacacccccgagugccccagcgccucccgcgcguggaacgugugggagguggaggacuacggguucggcgucuucaccaccaacaucuggcucaagcugcgggagauguacacccagaugugcgaccaccgccugaugagcgccgccgugaaggacgagcgggccgugcacgccgacaugggcuacuggaucgagagccagaagaacggguccuggaagcucgagaaggcgagccugaucgaggucaagacgugcaccuggccgaagucccacacccuguggagcaacggcgugcucgaguccgacaugaucauccccaagagccuggccgggcccaucucccagcacaacuaccgcccgggcuaccacacccagacggccgggcccuggcaccugggcaagcucgagcuggacuucaacuacugcgagggcaccaccguggucaucaccgagaacugcgggacgcggggccccagccugcgcaccaccaccguguccgggaagcucauccacgaguggugcugccggagcugcacgcugcccccgcugcgcuacaugggcgaggacgggugcugguacggcauggagauccggcccaucuccgagaaggaggagaacauggucaagagccucgucuccgccggcagcgggaagguggacaacuucaccaugggcgugcugugccuggccauccucuucgaggaggucaugcgcgggaaguucggcaagaagcacaugaucgcggggguguucuucaccuucgugcugcugcucuccggccagaucaccuggcgggacauggcccacacgcugaucaugaucggcagcaacgccuccgaccgcauggggaugggcgucaccuaccuggcccucaucgccaccuucaagauccagcccuuccuggcgcugggguucuuccuccggaagcugaccagccgcgagaaccugcuccugggcgugggccuggccauggccacgacccuccagcugcccgaggacaucgagcagauggccaacgggaucgcgcugggccucauggcccugaagcugaucacccaguucgagaccuaccagcucuggacggcccugaucagccugaccugcuccaacaccaucuucacccucacgguggccuggcggaccgccacccugauccuggcgggggucagccuccugccggugugccaguccagcuccaugcgcaagaccgacuggcugcccaugacggucgccgccaugggcgugccgccccugccgcuguucaucuucagccugaaggacacccucaagcgccgguccuggccccugaacgagggggugauggccgucggccuggugagcauccucgccuccagccugcugcgcaacgacgugcccauggcgggcccccucgucgccgggggccugcugaucgccugcuacgugaucaccgggaccuccgccgaccucacgguggagaaggccgcggacgucaccugggaggaggaggccgagcagaccggcgugagccacaaccugaugaucaccguggacgacgacgggaccaugcggaucaaggacgacgagacggagaacauccugaccguccuccugaagaccgcccugcucaucguguccggcaucuucccguacagcauccccgccacccugcugguguggcacacguggcagaagcagacccagcgcuccggcguccucugggacgugcccagcccgcccgagacccagaaggccgagcuggaggaggggguguaccggaucaagcagcagggcauccuggggaagacccaggucggcgugggggugcagaaggagggcgucuuccacacgauguggcacgugacccgcggcgcggugcucacccacaacgggaagcggcuggagcccaacugggccuccgucaagaaggaccugaucagcuacggcgggggcuggcgccucuccgcccaguggcagaagggggaggagguccaggugaucgccgucgagcccggcaagaaccccaagaacuuccagaccaugcccggcacguuccagaccaccaccggggagaucggcgcgaucgcccuggacuucaagcccgggacgagcggcagccccaucaucaaccgggagggcaaggugguggggcuguacggcaacggggucgugaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggccaucguccgcgaggcgaucaagcggcgccuccggacccugauccuggcccccacccgcgugguggccgccgagauggaggaggcccucaaggggcugcccauccgguaccagacgaccgcgaccaaguccgagcacaccggccgcgagaucgucgaccugaugugccacgccacguucaccaugcggcuccugagccccgugcgcgugccgaacuacaaccugaucaucauggacgaggcccacuucaccgaccccgccuccaucgccgcgcggggguacaucagcacccgcgucggcaugggcgaggccgccgccaucuucaugacggcgacgccgcccgggaccgccgacgccuucccgcaguccaacgcccccauccaggacgaggagcgcgacauccccgagcggagcuggaacuccggcaacgaguggaucaccgacuucgccgggaagacggugugguucgugcccagcaucaaggcgggcaacgacaucgccaacugccuccgcaagaacgggaagaaggucauccagcugucccggaagaccuucgacaccgaguaccagaagaccaagcugaacgacugggacuucguggugacgaccgacaucagcgagaugggcgccaacuucaaggccgaccgcgucaucgacccgcggcgcugccucaagcccgugauccugaccgacggccccgagcgggugauccuggccgggcccaugccggucaccgcggccuccgccgcccagcgccggggccgcguggggcggaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgcgagaaguccgccgccaucgacggcgaguaccggcugaagggcgagucccgcaagaccuucguggagcugaugcggcgcggggaccuccccgucuggcuggcgcacaagguggccagcgagggcaucaaguacaccgaccggaaguggugcuucgacgggcagcgcaacaaccagauccuggaggagaacauggacgucgagaucuggacgaaggagggcgagaagcggaagcuccgcccccgcuggcuggacgcccggaccuacuccgacccgcuggcccucaaggaguucaaggacuucgccgcgggccgcaagagcaucgcccuggaccuggugaccgagaucgggcgggugcccucccaccucgcccaccgcacccggaacgcccuggacaaccuggucaugcuccacacgagcgagcacggcgggcgcgccuaccggcacgcgguggaggagcugcccgagaccauggagacccugcuccugcugggccucaugauccugcugaccgggggcgccacccucuuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagacgaccaagcgggaccugggcauguccaaggagccggggguggugagccccaccuccuaccuggacgucgaccuccaccccgccagcgccuggacccuguacgccguggcgacgaccgugaucacccccaugcugcgccacaccaucgagaacuccacggccaacgucagccucgccgccaucgccaaccaggcgguggugcugaugggccuggacaagggguggccgaucuccaagauggaccucggcgucccccugcuggcccucgggugcuacagccaggugaacccccugacccugaccgccgccgugcuccugcugaucacccacuacgccaucaucggccccggccuccaggcgaaggccacgcgggaggcccagaagcgcaccgccgccgggaucaugaagaacccgaccgucgacggcaucaucaccaucgaccuggaccccgugaucuacgacuccaaguucgagaagcagcugggccaggugaugcuccugguccugugcgcggugcagcuccugcugaugcggacgagcugggcccucugcgaggcccugacccuggccaccggccccaucaccacgcucugggagggcucccccgggaaguucuggaacaccaccaucgcggugagcauggccaacaucuuccgcggcuccuaccuggcccgggccgggcuggccuucagcaucaugaaguccgucggcaccgggaagcgcggcaccggcagccagggggagacgcucggcgagaaguggaagaagaagcugaaccagcugagccggaaggaguucgaccucuacaagaaguccgggaucaccgagguggaccgcaccgaggcgaaggagggccugaagcgcggggagaccacgcaccacgccgugagccgcggcuccgccaagcugcagugguucgucgagcggaacauggugaucccggagggccgcgugaucgaccucgggugcggccgcgggggcuggagcuacuacugcgccgggcugaagaaggucaccgaggugcggggcuacaccaagggcgggcccggccacgaggagcccgugcccauguccaccuacggguggaacaucgucaagcugaugagcggcaaggacguguucuaccucccgcccgagaagugcgacacgcugcugugcgacaucggggaguccagccccucccccaccguggaggagagccgcaccauccggguccugaagaugguggagccguggcucaagaacaaccaguucugcaucaaggugcugaaccccuacaugcccgccgucaucgagcaccuggagcgccuccagcggaagcacggcggcaugcuggugcgcaacccccugucccggaacagcacccacgagauguacuggaucuccaacgggacgggcaacaucgugagcuccgucaacauggugagcaagcuccugcugaaccgcuucaccaugacccaccggcgcccgaccaucgagaaggacguggaccucggggcgggcacgcggcacgucaacgccgagcccgagacccccaacauggacgugaucggcgagcgcaucaagcggaucaaggaggagcacaacuccaccuggcacuacgacgacgagaacccguacaagaccugggccuaccacgggagcuacgaggugaaggccacgggcuccgccagcagcaugaucaacggggucgugaagcugcugaccaagcccugggacgucgugcccauggugacccagauggcgaugaccgacacgacccccuucggccagcagcgcgucuucaaggagaagguggacacccggaccccgcgccccaugcccgggacgcggaaggugauggagaucaccgccgaguggcucuggcgcacccugggccggaacaagcgcccccgccugugcacccgggaggaguucacgaagaagguccgcaccaacgccgccaugggcgcgguguucaccgaggagaaccagugggacuccgccaaggccgccguggaggacgaggaguucuggaagcucgucgaccgggagcgcgagcugcacaagcuggggaagugcggcagcugcguguacaacaugauggggaagcgggagaagaagcucggcgaguucgggaaggccaagggcucccgcgcgaucugguacauguggcugggcgcccgguaccuggaguucgaggcccucggguuccugaacgaggaccacugguucagccgcgagaacuccuacagcggcguggagggggagggccugcacaagcucggguacauccugcgggacaucuccaagaucccgggcggcgccauguacgccgacgacaccgcggggugggacacgcgcaucaccgaggacgaccugcacaacgaggagaagaucacccagcagauggaccccgagcaccggcuccuggccaacgccaucuucaagcugaccuaccagaacaaggucgugaaggugcagcgccccacccccacgggcaccgucauggacaucaucagccggaaggaccagcgcggguccggccaggugggcaccuacgggcucaacaccuucacgaacauggaggcccagcuggugcggcagauggagggcgaggggguccugagcaaggccgaccucgagaacccgcaccuccccgagaagaagaucacccaguggcuggagaccaagggcguggagcgccucaagcggauggcgaucuccggggacgacugcguggucaagcccaucgacgaccgcuucgccaacgcccugcuggcccucaacgacaugggcaaggugcggaaggacaucccccaguggcagccgagcaagggcuggcacgacuggcagcagguccccuucugcucccaccacuuccacgagcugaucaugaaggacgggcgcaagcuggucgugcccugccggccccaggacgagcucaucggccgcgcccgcaucagccagggggcgggcuggucccugcgggagaccgccugccuggggaaggccuacgcccagauguggagccucauguacuuccaccgccgggaccugcgccuggcguccaacgccaucugcagcgccgugccgguccacugggugcccacgucccggaccaccuggagcauccacgcccaccaccaguggaugaccacggaggacaugcucaccguguggaaccgcgucuggaucgaggacaaccccuggauggaggacaagacccccgugaccacgugggagaacgugccguaccugggcaagcgggaggaccaguggugcggcagccugaucgggcucaccucccgcgccaccugggcgcagaacauccccaccgccauccagcagguccggagccugaucggcaacgaggaguuccuggacuacaugcccuccaugaagcgcuuccggaaggaggaggagcucgagggggccaucugguga

SEQ ID NO: 9856 - RNA, 9873 nt, Artificial Sequence
  derived and/or modified CDS sequence (opt1) from DENV-3__KX380841__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccaggggaucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgccaagaagcaggagguggucgugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggaggucuccgagacccagcacgggaccauccucaucaagguggaguacaagggcgaggacgcgccgugcaagauccccuucagcaccgaggacgggcagggcaaggcccacaacggccgccugaucacggccaaccccguggucaccaagaaggaggagcccgugaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgucggcggggugcucaacagccugggcaagauggugcaccagaucuucggguccgccuacacggcccuguucagcggcgucuccugggugaugaagaucggcaucggggugcuccugaccuggaucggccugaacagcaagaacaccuccaugagcuucuccugcaucgccaucgggaucaucacccucuaccugggcgccgucgugcaggcggacauggggugcgugaucaacuggaagggcaaggagcugaagugcggcagcgggaucuucgucacgaacgaggugcacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccgucguggugggggacaccaucggcguccucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgugugggaggucgaggacuacggguucggcguguucaccaccaacaucuggcucaagcugcgcgagguguacacccagaugugcgaccaccggcugaugagcgccgccgucaaggacgagcgcgccgugcacgcggacaugggcuacuggaucgagagccagaagaacggguccuggaagcucgagaaggccagccugaucgaggugaagacgugcaccuggccgaagucccacacccuguggagcaacggcguccucgaguccgacaugaucauccccaagagccuggccgggcccaucucccagcacaacuaccggccgggcuaccacacccagacggccgggcccuggcaccugggcaagcucgagcuggacuucaacuacugcgagggcaccaccguggugaucaccgagaacugcgggacgcgcggccccagccugcggaccaccaccgucuccgggaagcucauccacgaguggugcugccgcagcugcacgcugcccccgcugcgguacaugggcgaggacgggugcugguacggcauggagauccgccccaucuccgagaaggaggagaacauggucaagagccucguguccgccggcagcgggaaggucgacaacuucaccaugggcgugcugugccuggcgauccucuucgaggaggugaugcgggggaaguucggcaagaagcacaugaucgccggggucuucuucaccuucgugcugcugcucuccggccagaucaccuggcgcgacauggcccacacgcugaucaugaucggcagcaacgccuccgaccggauggggaugggcgugaccuaccuggcccucaucgcgaccuucaagauccagcccuuccuggcccugggguucuuccuccgcaagcugaccagccgggagaaccugcuccugggcgucggccuggccauggccacgacccuccagcugcccgaggacaucgagcagauggcgaacgggaucgcccugggccucauggcccugaagcugaucacccaguucgagaccuaccagcucuggacggcccugaucagccugaccugcuccaacaccaucuucacccucacgguggccuggcgcaccgcgacccugauccuggccggggugagccuccugccggucugccaguccagcuccaugcggaagaccgacuggcugcccaugacgguggccgccaugggcgugccgccccucccgcuguucaucuucagccugaaggacacccucaagcgccgcuccuggccccugaacgagggggugauggccgugggccuggucagcauccucgcguccagccugcugcggaacgacgugcccauggccggcccccucguggccgggggccugcugaucgccugcuacgucaucaccgggaccuccgccgaccucacgguggagaaggcggccgacgugaccugggaggaggaggccgagcagaccggcgucagccacaaccugaugaucaccguggacgacgacgggaccaugcgcaucaaggacgacgagacggagaacauccugaccgugcuccugaagaccgcccugcucaucgucuccggcaucuucccguacagcauccccgccacccugcugguguggcacacguggcagaagcagacccagcgguccggcgugcucugggacguccccagcccgcccgagacccagaaggcggagcuggaggaggggguguaccgcaucaagcagcagggcauccuggggaagacccaggugggcgucggggugcagaaggacggcguguuccacacgauguggcacgucacccggggcgccgugcucacccacaacgggaagcgccuggagcccaacugggccuccgugaagaaggaccugaucagcuacggcgggggcuggcggcucuccgcccaguggcagaagggggaggagguccaggugaucgcgguggagcccggcaagaaccccaagaacuuccagaccaugcccggcacguuccagaccaccaccggggagaucggcgccaucgcccuggacuucaagcccgggacgagcggcagccccaucaucaaccgcgagggcaaggucguggggcuguacggcaacgggguggucaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucgugcgggaggccaucaagcgccggcuccgcacccugauccuggcccccacccgggucguggccgccgagauggaggaggcgcucaaggggcugcccauccgcuaccagacgaccgccaccaaguccgagcacaccggccgggagaucguggaccugaugugccacgccacguucaccaugcgccuccugagccccguccgggugccgaacuacaaccugaucaucauggacgaggcccacuucaccgaccccgccuccaucgcggcccgcggguacaucagcacccgggugggcaugggcgaggccgccgcgaucuucaugacggccacgccgcccgggaccgccgacgccuucccgcaguccaacgcccccauccaggacgaggagcgcgacauccccgagcgcagcuggaacuccggcaacgaguggaucaccgacuucgcggggaagacggucugguucgugcccagcaucaaggccggcaacgacaucgccaacugccuccggaagaacgggaagaaggugauccagcugucccgcaagaccuucgacaccgaguaccagaagaccaagcugaacgacugggacuucgucgugacgaccgacaucagcgagaugggcgccaacuucaaggccgaccgggugaucgacccgcgccggugccucaagcccgucauccugaccgacggccccgagcgcgugauccuggcggggcccaugccggugaccgccgccuccgccgcccagcggcgcggccgggucgggcgcaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgggagaaguccgccgcgaucgacggcgaguaccgccugaagggcgagucccggaagaccuucguggagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacuccgacccgcuggcccucaaggaguucaaggacuucgcggccggccgcaagagcaucgcccuggaccuggucaccgagaucgggcgggugcccucccaccucgcccaccgcacccggaacgcccuggacaaccuggugaugcuccacacgagcgagcacggcgggcgcgcguaccggcacgccgucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucgugcuggaguucuucaugaugguccuccugauccccgagcccgagaagcagcgcacgccccaggacaaccagcuggccuacguggugaucgggauccucaccauggccgccaucaucgcggccaacgagaugggccugcuggagaccacgaagcgggaccucggcauguccaaggagccgggggucgugagccccaccuccuaccuggacguggaccugcaccccgccagcgccuggacccucuacgcggucgccaccacggugaucacccccaugcugcgccacaccaucgagaacuccaccgccaacgugagccuggccgccaucgcgaaccaggccgucgugcucaugggccuggacaagggguggccgaucuccaagauggaccugggcgugccccuccuggcccuggggugcuacagccaggucaacccccucacgcugaccgccgccgugcugcuccuggugacccacuacgcgaucaucggccccggccugcaggccaaggccacccgggaggcccagaagcgcacggccgcggggaucaugaagaacccgaccgucgacggcaucaucaccaucgaccucgaccccgugaucuacgacuccaaguucgagaagcagcugggccaggugaugcugcucguccugugcgccgugcagcugcuccugaugcggaccagcugggcccugugcgaggcccucacgcuggcgaccggccccaucaccacccugugggagggcucccccgggaaguucuggaacacgaccaucgccgugagcauggccaacaucuuccgcggcuccuaccucgccggggccggccuggcguucagcaucaugaaguccgucgggaccggcaagcggggcaccgggagccagggcgagacccugggggagaaguggaagaagaagcucaaccagcugagccgcaaggaguucgaccuguacaagaaguccggcaucacggagguggaccggaccgaggccaaggaggggcucaagcgcggcgagaccacccaccacgccgugagccggggcuccgccaagcugcagugguucgucgagcgcaacauggugaucccggaggggcgggugaucgaccugggcugcgggcgcggcggguggagcuacuacugcgccggccucaagaaggucacggaggugcggggcuacaccaagggcgggcccgggcacgaggagcccgugcccauguccaccuacggcuggaacaucgucaagcugaugagcgggaaggacguguucuaccugccgcccgagaagugcgacacccuccugugcgacaucggcgaguccagccccucccccacgguggaggagagccgcaccauccgcguccugaagaugguggagccguggcugaagaacaaccaguucugcaucaaggugcucaaccccuacaugcccgcggucaucgagcaccuggagcggcugcagcgcaagcacggcgggaugcucgugcggaacccccugucccgcaacagcacccacgagauguacuggaucuccaacggcaccgggaacaucgugagcuccgucaacauggugagccggcugcuccugaaccgcuucacgaugacccaccggcgcccgaccaucgagaaggacguggaccugggcgccggcacccggcacgucaacgccgagcccgagacgcccaacauggacgugaucggggagcgcaucaagcggaucaaggaggagcacaacuccaccuggcacuacgacgacgagaacccguacaagaccugggccuaccacggcagcuacgaggugaaggccaccggguccgcgagcagcaugaucaacggcgucgugaagcuccugacgaagcccugggacgucgugcccauggugacccagauggccaugaccgacaccacgcccuucgggcagcagcgcgucuucaaggagaagguggacacccggaccccgcgccccaugcccggcacccggaaggugauggagaucacggccgaguggcuguggcgcacccucggccggaacaagcgcccccggcugugcacccgcgaggaguucaccaagaagguccgcacgaacgccgcgaugggggccguguucaccgaggagaaccagugggacuccgccaaggccgccguggaggacgaggaguucuggaagcuggucgaccgggagcgcgagcuccacaagcugggcaagugcgggagcugcguguacaacaugaugggcaagcgggagaagaagcugggggaguucggcaaggcgaagggcucccgcgccaucugguacauguggcucggggcccgguaccuggaguucgaggcccugggcuuccucaacgaggaccacugguucagccgcgagaacuccuacagcgggguggagggcgaggggcugcacaagcugggcuacauccuccgggacaucuccaagaucccgggcggggccauguacgcggacgacaccgccggcugggacacccgcaucacggaggacgaccugcacaacgaggagaagaucacccagcagauggaccccgagcaccggcugcucgccaacgccaucuucaagcugaccuaccagaacaaggucgugaaggugcagcgccccacccccaccgggacggucauggacaucaucagccggaaggaccagcgcggcuccggccagguggggaccuacggccugaacaccuucaccaacauggaggcccagcucgugcggcagauggagggggagggcguccugagcaagacggaccuggagaacccgcaccuccccgagaagaagaucacccaguggcuggagaccaaggggguggagcgccugaagcggauggcgaucuccggcgacgacugcguggucaagcccaucgacgaccgcuucgccaacgcccuccuggcccugaacgacaugggcaaggugcggaaggacaucccccaguggcagccgagcaagggguggcacgacuggcagcagguccccuucugcucccaccacuuccacgagcucaucaugaaggacggccgcaagcuggucgugcccugccggccccaggacgagcugaucgggcgcgcccggaucagccagggcgcgggguggucccuccgcgagaccgccugccugggcaaggccuacgcccagauguggagccugauguacuuccaccgccgggaccuccgccuggcguccaacgccaucugcagcgccgugccgguccacugggugcccacgucccggaccaccuggagcauccacgcccaccaccaguggaugaccacggaggacaugcugaccguguggaaccgcgucuggaucgaggacaaccccuggauggaggacaagacccccaucaccacgugggagaacgugccguaccucggcaagcgggaggaccaguggugcgggagccugaucggccugaccucccgcgccaccugggcgcagaacauccccaccgccauccagcagguccggagccucaucgggaacgaggaguuccuggacuacaugcccuccaugaagcgcuuccggaaggaggaggagagcgagggcgccaucugguga

SEQ ID NO: 9857 - RNA, 9873 nt, Artificial Sequence
  derived and/or modified CDS sequence (opt1) from DENV-3__KX380842__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccaggggaucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgccaagaagcaggagguggucgugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggaggucuccgagacccagcacgggaccauccucaucaagguggaguacaagggcgaggacgcgccgugcaagauccccuucagcaccgaggacgggcagggcaaggcccacaacggccgccugaucacggccaaccccguggucaccaagaaggaggagcccgugaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgucggcggggugcucaacagccugggcaagauggugcaccagaucuucggguccgccuacacggcccuguucagcggcgucuccugggugaugaagaucggcaucggggugcuccugaccuggaucggccugaacagcaagaacaccuccaugagcuucuccugcaucgccaucgggaucaucacccucuaccugggcgccgucgugcaggcggacauggggugcgugaucaacuggaagggcaaggagcugaagugcggcagcgggaucuucgucacgaacgaggugcacaccuggaccgagcaguacaaguuccaggccgacucccccaagcgccucgccaccgccaucgugggcgccugggagaacggggucugcggcauccgcagcacgacccggauggagaaccugcuguggaagcagaucgcgaacgagcucaacuacauccugugggagaacaacaucaagcugaccgugguggucggggacaccaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgccucccgggcguggaacgucugggagguggaggacuacggguucggcguguucaccaccaacaucuggcucaagcugcgcgaggucuacacccagaugugcgaccaccggcugaugagcgccgccgugaaggacgagcgcgccgugcacgccgacaugggcuacuggaucgagagccagaagaacggguccuggaagcucgagaaggcgagccugaucgaggucaagacgugcaccuggccgaagucccacacccuguggagcaacggcgugcucgaguccgacaugaucauccccaagagccuggccgggcccaucucccagcacaacuaccggccgggcuaccacacccagacggccgggcccuggcaccugggcaagcucgagcuggacuucaacuacugcgagggcaccaccguggucaucaccgagaacugcgggacgcgcggccccagccugcggaccaccaccguguccgggaagcucauccacgaguggugcugccgcagcugcacgcugcccccgcugcgguacaugggcgaggacgggugcugguacggcauggagauccgccccaucuccgagaaggaggagaacauggucaagagccucgucuccgccggcagcgggaagguggacaacuucaccaugggcgugcugugccuggccauccucuucgaggaggucaugcgggggaaguucggcaagaagcacaugaucgcggggguguucuucaccuucgugcugcugcucuccggccagaucaccuggcgcgacauggcccacacgcugaucaugaucggcagcaacgccuccgaccggauggggaugggcgucaccuaccuggcccucaucgccaccuucaagauccagcccuuccuggcgcugggguucuuccuccgcaagcugaccagccgggagaaccugcuccugggcgugggccuggccauggccacgacccuccagcugcccgaggacaucgagcagauggccaacgggaucgcgcugggccucauggcccugaagcugaucacccaguucgagaccuaccagcucuggacggcccugaucagccugaccugcuccaacaccaucuucacccucacgguggccuggcgcaccgccacccugauccuggcgggggucagccuccugccggugugccaguccagcuccaugcggaagaccgacuggcugcccaugacggucgccgccaugggcgugccgccccucccgcuguucaucuucagccugaaggacacccucaagcgccgcuccuggccccugaacgagggggugauggccgucggccuggugagcaugcucgccuccagccugcugcggaacgacgugcccauggcgggcccccucgucgccgggggccugcugaucgccugcuacgugaucaccgggaccuccgccgaccucacgguggagaaggccgcggacgucaccugggaggaggaggccgagcagaccggcgugagccacaaccugaugaucaccguggacgacgacgggaccaugcgcaucaaggacgacgagacggagaacauccugaccguccuccugaagaccgcccugcucaucguguccggcaucuucccguacagcauccccgccacccugcugguguggcacacguggcagaagcagacccagcgguccggcguccucugggacgugcccagcccgcccgagacccagaaggccgagcuggaggaggggguguaccgcaucaagcagcagggcauccuggggaagacccaggucggcgugggggugcagaaggacggcgucuuccacacgauguggcacgugacccggggcgcggugcucacccacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcacguuccagaccaccaccggggagaucggcgcgaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggccaucguccgggaggcgaucaagcgccggcuccgcacccugauccuggcccccacccgggugguggccgccgagauggaggaggcccucaaggggcugcccauccgcuaccagacgaccgcgaccaaguccgagcacaccggccgggagaucgucgaccugaugugccacgccacguucaccaugcgccuccugagccccgugcgggugccgaacuacaaccugaucaucauggacgaggcccacuucaccgaccccgccuccaucgccgcgcgcggguacaucagcacccgggucggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggugugguucgugcccagcaucaaggcgggcaacgacaucgccaacugccuccggaagaacgggaagaaggucauccagcugucccgcaagaccuucgacaccgaguaccagaagaccaagcugaacgacugggacuucguggugacgaccgacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggacgaaggagggcgagaagaagaagcuccgcccccgguggcuggacgcccgcaccuacuccgacccgcuggcccucaaggaguucaaggacuucgccgcgggccgcaagagcaucgcccuggaccuggugaccgagaucgggcgggugcccucccaccucgcccaccgcacccggaacgcccuggacaaccuggucaugcuccacacgagcgagcacggcgggcgcgccuaccggcacgcgguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucaccauggccgccaucaucgccgcgaacgagaugggccugcuggagaccacgaagcgggaccucggcauguccaaggagccggggguggugagccccaccuccuaccuggacgucgaccugcaccccgccagcgccuggacccucuacgccguggcgaccacggugaucacccccaugcugcgccacaccaucgagaacuccaccgccaacgucagccuggccgccaucgccaaccaggcgguggugcucaugggccuggacaagggguggccgaucuccaagauggaccugggcgucccccuccuggcccuggggugcuacagccaggugaacccccucacgcugaccgccgccgugcugcuccuggucacccacuacgccaucaucggccccggccugcaggcgaaggccacccgggaggcccagaagcgcacggccgccgggaucaugaagaacccgaccguggacggcaucaucaccaucgaccucgaccccgugaucuacgacuccaaguucgagaagcagcuggggcaggucaugcugcucgugcugugcgcggugcagcugcuccugaugcggaccagcugggcccugugcgaggcccucacgcuggccaccggccccaucaccacccugugggagggcucccccgggaaguucuggaacacgaccaucgcggucagcauggccaacaucuuccgcggcuccuaccucgccggggccggccuggccuucagcaucaugaaguccguggggaccggcaagcggggcaccgggagccagggcgagacccugggggagaaguggaagaagaagcucaaccagcugagccgcaaggaguucgaccuguacaagaaguccggcaucacggagguggaccggaccgaggcgaaggaggggcucaagcgcggcgagaccacccaccacgccgucagccggggcuccgccaagcugcagugguucguggagcgcaacauggugaucccggaggggcgggucaucgaccugggcugcgggcgcggcggguggagcuacuacugcgccggccucaagaaggugacggaggugcggggcuacaccaagggcgggcccgggcacgaggagcccguccccauguccaccuacggcuggaacaucgugaagcugaugagcgggaaggacguguucuaccugccgcccgagaagugcgacacccuccugugcgacaucggcgaguccagccccucccccacggucgaggagagccgcaccauccgcgugcugaagaugguggagccguggcugaagaacaaccaguucugcaucaagguccucaaccccuacaugcccgccgugaucgagcaccuggagcggcugcagcgcaagcacggcgggaugcucgugcggaacccccugucccgcaacagcacccacgagauguacuggaucuccaacggcaccgggaacaucgucagcuccgugaacauggugagccggcugcuccugaaccgcuucacgaugacccaccggcgcccgaccaucgagaaggacgucgaccugggcgcgggcacccggcacgugaacgccgagcccgagacgcccaacauggacgugaucggggagcgcaucaagcggaucaaggaggagcacaacuccaccuggcacuacgacgacgagaacccguacaagaccugggccuaccacggcagcuacgaggucaaggccaccggguccgccagcagcaugaucaacggcguggucaagcuccugacgaagcccugggacguggugcccauggucacccagauggcgaugaccgacaccacgcccuucgggcagcagcgcguguucaaggagaagguggacacccggaccccgcgccccaugcccggcacccggaaggucauggagaucacggccgaguggcuguggcgcacccucggccggaacaagcgcccccggcugugcacccgcgaggaguucaccaagaaggugcgcacgaacgccgccaugggggcgguguucaccgaggagaaccagugggacuccgccaaggccgccgucgaggacgaggaguucuggaagcugguggaccgggagcgcgagcuccacaagcugggcaagugcgggagcugcguguacaacaugaugggcaagcgggagaagaagcugggggaguucggcaaggccaagggcucccgcgcgaucugguacauguggcucggggcccgguaccuggaguucgaggcccugggcuuccucaacgaggaccacugguucagccgcgagaacuccuacagcggggucgagggcgaggggcugcacaagcugggcuacauccuccgggacaucuccaagaucccgggcggggccauguacgccgacgacaccgcgggcugggacacccgcaucacggaggacgaccugcacaacgaggagaagaucacccagcagauggaccccgagcaccggcugcucgccaacgccaucuucaagcugaccuaccagaacaagguggugaagguccagcgccccacccccaccgggacggugauggacaucaucagccggaaggaccagcgcggcuccggccagguggggaccuacggccugaacaccuucaccaacauggaggcccagcucguccggcagauggagggggagggcgugcugagcaagacggaccuggagaacccgcaccuccccgagaagaagaucacccaguggcuggagaccaaggggguggagcgccugaagcggauggccaucuccggcgacgacugcgucgugaagcccaucgacgaccgcuucgcgaacgcccuccuggcccugaacgacaugggcaaggugcggaaggacaucccccaguggcagccgagcaagggguggcacgacuggcagcagguccccuucugcucccaccacuuccacgagcucaucaugaaggacggccgcaagcugguggugcccugccggccccaggacgagcugaucgggcgcgcccggaucagccagggcgccggguggucccuccgcgagaccgcgugccugggcaaggccuacgcccagauguggagccugauguacuuccaccgccgggaccuccgccuggccuccaacgcgaucugcagcgccaucccgguccacugggugcccacgucccggaccaccuggagcauccacgcccaccaccaguggaugaccacggaggacaugcugaccguguggaaccgcgucuggaucgaggacaaccccuggauggaggacaagacccccaucaccacgugggagaacgugccguaccucggcaagcgggaggaccaguggugcgggagccugaucggccugaccucccgcgccaccugggcccagaacauccccaccgcgauccagcagguccggagccucaucgggaacgaggaguuccuggacuacaugcccuccaugaagcgcuuccggaaggaggaggagagcgagggcgccaucugguga

SEQ ID NO: 9858 - RNA, 9873 nt, Artificial Sequence
  derived and/or modified CDS sequence (opt1) from DENV-3__KX380839__SS-prME
accagccugugccucaugaugaugcugcccgccacccuggccuuccaccucaccagccgggacggggagccccggaugaucguggggaagaacgagcggggcaagagccugcuguucaagaccgccagcgggaucaacaugugcacccucaucgccauggaccugggcgagaugugcgacgacaccaucacguacaagugcccccugaucaccgagguggagcccgaggacaucgacugcuggugcaaccucaccagcaccugggugacguacgggaccugcaaccaggccggcgagcaccggcgcgacaagcggagcguggcccuggcgccccacgugggcauggggcuggacacccgcgcgcagaccuggaugagcgccgagggcgccuggcgccagguggagaagguggagacgugggccuuccgccaccccggguucaccauccucgcgcuguuccuggcccacuacaucggcaccagccucacccagaaggucgugaucuucauccugcugaugcucgugacgcccagcaugaccaugcggugcgucggggugggcaaccgcgacuucguggagggccuguccggggccaccugggucgacguggugcuggagcacggcgggugcgucaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcucacggagggcaaggugguccagcacgagaaccugaaguacaccgugaucaucaccgugcacaccggggaccagcaccaggucggcaacgagacgcagggggugaccgccgagaucacgccccaggccagcaccgucgaggcgaucuuccgcuccuacggcacccuggggcucgagugcagcccccggacgggccuggacuucaacgagaugauccugcucaccaugaagaacaaggccuggauggugcaccgccagugguucuucgaccugccccugccguggaccuccggcgccaccacggagacccccaccuggaacaagaaggagcuccuggugaccuucaagaacgcccacgccaagaagcaggaggucguggugcuggggagccaggagggcgcgaugcacacggcccucaccggggccaccgagauccagaccuccggcgggacgagcaucuucgccggccaccugaagugccggcugaagauggacaagcucgagcugaagggcauguccuacgccaugugcagcaacgcguucguccugaagaaggaggugagcgagacccagcacgggaccauccucaucaagguggaguacaagggcgaggacgcccccugcaagauccccuucuccaccgaggacgggcagggcaaggcccacaacggccgccugaucacggccaacccggucgugaccaagaaggaggagcccgugaacaucgaggcggagccgcccuucggggagagcaacaucaucaucggcaucggggacaaggcccugaagaucaacugguacaagaagggcuccagcaucgggaagauguucgaggccaccgcccggggcgcccgccggauggcgauccugggcgacaccgccugggacuucggguccgucggcggggugcucaacagccugggcaagauggugcaccagaucuucggguccgccuacacggcccuguucagcggcgucuccuggaucaugaagaucggcaucggggugcuccugaccuggaucggccugaacagcaagaacaccuccaugagcuucuccugcaucgugaucgggaucaucacccucuaccugggcgccgucgugcaggcggacauggggugcgugaucaacuggaagggcaaggagcugaagugcggcagcgggaucuucgucacgaacgaggugcacaccuggaccgagcaguacaaguuccaggccgacuccccgaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccgucguggugggggacaucaucggcauccucgagcagggcaagcgcacccugacgccccagcccauggagcugaaguacuccuggaagaccugggggaaggccaagaucgucaccgccgagacccagaacagcuccuucaucaucgacggccccaacacgccggagugccccaacgcgagccgggccuggaacgugugggagguggaggacuacggguucggcgucuucaccaccaacaucuggcucaagcugcgcgagauguacacccagcugugcgaccaccggcucaugagcgccgccgugaaggacgagcgcgccgugcacgcggacaugggcuacuggaucgagucccagaagaacgggagcuggaagcuggagaaggccucccugaucgaggucaagaccugcacguggcccaagagccacacccucugguccaacggcgugcuggagagcgacaugaucauccccaagucccuggccgggccgaucagccagcacaacuaccggcccggcuaccacacccagaccgccgggcccuggcaccucggcaagcuggagcuggacuucaacuacugcgagggcacgaccguggucaucaccgagaacugcgggacccgcggcccgucccuccggacgaccaccgugagcgggaagcugauccacgaguggugcugccgcuccugcacccugccgccccuccgguacaugggcgaggacgggugcugguacggcauggagauccgccccaucaacgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccggggugcuguucaccuucgugcuccugcuguccggccagaucaccuggcgcgacauggcccggacccucaucaugaucggcagcaacgccuccgaccgcauggggaugggcgucacguaccuggcccugaucgcgaccuucaagauccagccguuccucgcccugggguucuuccugcggaagcucaccagccgcgagaaccugcugcucggcgugggccuggccauggccaccacgcugcagcuccccgaggacaucgagcagauggcgaacgggaucgcccugggccugauggcccucaagcugaucacccaguucgagaccuaccagcugugggccgcccucgugagccugaugugcuccaacaccaucuucacgcugaccgucgcguggcggaccgccacccucauccuggccgggaucagccugcuccccaugugccaguccagcuccaugcgcaagacggacuggcugcccaugaccguggccgccaugggcgugccgccccugccccucuucaucuucagccugaaggacacccugaagcgccgguccuggccccucaacgagggggucauggcggugggccuggucagcauccuggccuccagccuccugcgcaacgacgugccgauggccggcccccugguggccgggggccuccugaucgccugcuacgucaucaccgggacguccgcggaccugaccguggagaaggccgccgacgugaccugggaggaggaggccgagcagaccggcgucagccacaaccucaugaucacgguggacgacgacgggaccaugcggaucaaggacgacgagaccgagaacauccugaccgugcugcucaagaccgcccugcugaucgucuccggcaucuuccccuacagcauccccgcgacgcuccugguguggcacaccuggcagaagcagacccagcgcuccggcgugcugugggacgucccguccccgcccgagacccagaaggccgagcucgaggaggggguguaccggaucaagcagcagggcaucuucgggaagacccaggugggcgucggggugcagaaggagggcguguuccacaccauguggcacgucacccgcggcgccgugcugacccacaacgggaagcggcuggagcccaacugggccuccgugaagaaggaccucaucagcuacggcgggggcuggcgccuguccgcgcaguggcagaagggggaggagguccaggugaucgccguggagccgggcaagaaccccaagaacuuccagacgaugcccggcaucuuccagaccaccaccggggagaucggcgccaucgcccuggacuucaagcccgggacgagcggcagcccgaucaucaaccgggagggcaaggucguggggcuguacggcaacgggguggucaccaagaacggcggguacguguccggcaucgcccagaccaacgcggagcccgacggccccaccccggagcucgaggaggagauguucaagaagcgcaaccugacgaucauggaccugcaccccgggagcggcaagacccggaaguaccuccccgccaucgugcgcgaggccaucaagcggcgccugcggacccugauccucgcccccacccgcgucguggccgcggagauggaggaggcccugaaggggcugccgauccgguaccagacgaccgccaccaaguccgagcacaccggcaaggagaucguggaccucaugugccacgccacguucaccaugcgccugcugagccccguccgggugcccaacuacaaccucaucaucauggacgaggcccacuucaccgaccccgcguccaucgccgcccgcggguacaucagcacccgggugggcaugggcgaggccgcggccaucuucaugacggccaccccgcccgggaccgccgaggccuucccccaguccaacgcgcccauccaggacgaggagcgcgacaucccggagcgcagcuggaacuccggcaacgacuggaucaccgacuucgccgggaagacggucugguucgugcccagcaucaaggccggcaacgacaucgccaacugccugcggaagaacgggaagaaggugauccagcugucccgcaagaccuucgacaccgaguaccagaagaccaagcucaacgacugggacuucgucgugacgaccgacaucagcgagaugggcgccaacuucaaggcggaccgggugaucgacccccgccggugccugaagcccgucauccugaccgacggcccggagcgcgugauccucgccgggcccaugcccgugaccgucgccuccgccgcccagcggcgcggccggguggggcgcaacccccagaaggagaacgaccaguacaucuucacgggccagccgcugaacaacgacgaggaccacgcgcacuggaccgaggccaagaugcugcucgacaacaucaacacccccgaggggaucauccccgcccuguucgagcccgagcgggagaaguccgccgcgaucgacggcgaguaccgccugaagggcgagucccggaagaccuucguggagcucaugcgccgcggggaccugccggucuggcuggcccacaagguggccagcgagggcaucaaguacaccgaccgcaaguggugcuucgacggggagcggaacaaccagauccucgaggagaacauggacguggagaucuggacgaaggagggcgagaagaagaagcugcgcccccgguggcuggacgcccgcaccuacuccgacccccucgcccugaaggaguucaaggacuucgcggccggccgcaagagcaucgcccuggaccucgucaccgagaucgggcgggugcccccgcaccuggcccaccgcacccggaacgcccuggacaaccucgucaugcugcacacguccgaguacggcgggcgcgcguaccggcacgccguggaggagcugcccgagaccauggagacccuccugcugcucggccugaugauccugcucaccgggggcgugaugcuguuccugaucagcggcaagggggucggcaagacgagcaucgggcucaucugcgugguggccuccagcggcaugcuguggauggccgacaucccccugcaguggaucgccuccgcgaucguccucgaguucuucaugauggugcugcugaucccggagcccgagaagcagcgcacgccccaggacaaccagcucgccuacguggucaucgggauccugacccuggccgccaucguggccgcgaacgagaugggccuccuggagaccacgaagcgggaccugggcaugagcaaggagcccgggguggucuccccgaccagcuaccucgacguggaccugcaccccgccuccgccuggacccuguacgccguggcgaccacggucaucacccccaugcuccgccacaccaucgagaacagcaccgccaacgugucccuggccgccaucgccaaccaggcggugguccugaugggccucgacaagggguggcccaucagcaagauggaccugggcgugccgcugcucgcccuggggugcuacucccaggugaacccccugacgcucaccgccgccguccugcugcucgugacccacuacgccaucaucggccccggccugcaggcgaaggccacccgggaggcccagaagcgcacggccgccgggaucaugaagaaccccaccguggacggcaucaugaccaucgaccuggacccggucaucuacgacagcaaguucgagaagcagcucggccaggugaugcugcuggugcucugcgcgguccagcugcugcucaugcggaccuccugggccuucugcgaggcccugacgcuggccaccggccccaucaccacccucugggagggcagccccgggaaguucuggaacacgaccaucgcgguguccauggccaacaucuuccgcggcagcuaccuggccggggccggccuggccuucuccaucaugaaguccguggggaccggcaagcggggcaccgggucccagggcgagacgcucggggagaaguggaagaagaagcugaaccagcugagccgcaaggaguucgaccucuacaagaaguccggcaucaccgaggucgaccggaccgaggcgaaggaggggcugaagcgcggcgagaucacccaccacgccgugucccggggcagcgccaagcugcagugguucguggagcgcaacauggucauccccgaggggcgggugaucgaccucggcugcgggcgcggcgggugguccuacuacugcgccggccugaagaaggugaccgagguccggggcuacacgaagggcgggccggggcacgaggagcccgugcccaugagcaccuacggcuggaacaucgugaagcugaucuccgggaaggacgucuucuaccucccgcccgagaagugcgacacccugcugugcgacaucggcgagagcucccccagccccaccguggaggagucccgcacgauccgcgugcugaagauggucgagcccuggcucaagaacaaccaguucugcaucaaggugcugaaccccuacaugcccgccgugaucgagcaccuggagcggcuccagcgcaagcacggcgggaugcugguccggaacccccugagccgcaacuccacccacgagauguacuggaucagcaacggcaccgggaacaucguguccagcgugaacaugaucucccggcuccugcugaaccgcuucaccaugacguaccggcgccccaccaucgagaaggacgucgaccucggcgcgggcacccggcacgugaacgccgagccggagacccccaacauggacgugaucggggagcgcauccggcgcaucaaggaggagcacagcuccacguggcacuacgacgacgagaaccccuacaagaccugggccuaccacggcagcuacgaggucaaggccaccggguccgccagcagcaugaucaacggcguggucaagcugcugaccaagccgugggacguggugcccacggucacccagauggcgaugaccgacaccacgcccuucgggcagcagcggguguucaaggagaagguggacacccgcacccccaagccgaugcccggcacccggaaggucauggagaucacggccgaguggcucuggcgcacccugggccggaacaagcgcccccggcugugcacccgcgaggaguucaccaagaaggugcgcacgaacgccgccaugggggcgguguucaccgaggagaaccagugggacuccgcccgggccgccgucgaggacgaggaguucuggaagcucguggaccgcgagcgggagcugcacaagcugggcaagugcgggagcugcguguacaacaugaugggcaagcgcgagaagaagcucggggaguucggcaaggccaagggcucccgggcgaucugguacauguggcugggggcccgcuaccuggaguucgaggcccucggcuuccugaacgaggaccacugguucagccgggagaacuccuacagcggggucgagggcgaggggcugcacaagcucggcuacauccugcgcgacaucuccaagauccccggcggggccauguacgccgacgacaccgcgggcugggacacccggaucacggaggacgaccugcacaacgaggagaagaucacccagcagauggacccggagcaccgccagcucgccaacgccaucuucaagcugaccuaccagaacaagguggugaagguccagcggcccacccccaaggggacggugauggacaucaucagccgcaaggaccagcggggcuccggccagguggggaccuacggccugaacaccuucaccaacauggaggcccagcucauccgccagauggagggggagggcguccugagcaagaccgaccuggagaacccccaccuccuggagaagaagaucacgcaguggcuggagaccaaggggguggagcggcucaagcgcauggccaucuccggcgacgacugcguggucaagccgaucgacgaccgguucgcgaacgcccugcuggcccucaacgacaugggcaaggugcgcaaggacaucccccaguggcagcccagcaagggguggcacgacuggcagcagguccccuucugcucccaccacuuccacgagcugaucaugaaggacggccggaagcuggucgugccgugccgcccccaggacgagcucaucgggcgggcccgcaucagccagggcgccggguggucccugaaggagaccgcgugccugggcaaggccuacgcccagaugugggcccucauguacuuccaccgccgggaccugcgccuggcgagcaacgccaucugcuccgccgugcccguccacugggugcccaccagccggacgaccugguccauccacgcccaccaccaguggaugaccaccgaggacaugcucacgguguggaaccgcgucuggaucgaggacaacccguggauggaggacaagacccccgugaccaccugggaggacgugcccuaccugggcaagcgggaggaccaguggugcgggagccugaucggccucacgagccgcgccaccugggcgcagaacauccugaccgccauccagcagguccggucccugaucgggaacgaggaguuccucgacuacaugcccagcaugaagcgcuuccggaaggaggaggaguccgagggcgccaucugguga

SEQ ID NO: 9859 - RNA, 9873 nt, Artificial Sequence
  derived and/or modified CDS sequence (opt1) from DENV-3__KX380840__SS-prME
accucccugugccucaugaugaugcugcccgccacccuggccuuccaccucaccucccgggacggggagccccggaugaucguggggaagaacgagcggggcaagagccugcuguucaagaccgccuccgggaucaacaugugcacccucaucgccauggaccugggcgagaugugcgacgacaccaucacguacaagugcccccugaucaccgagguggagcccgaggacaucgacugcuggugcaaccucaccagcaccugggugacguacgggaccugcaaccaggccggcgagcaccggcgcgacaagcgguccguggcccuggcgccccacgugggcauggggcuggacacccgcgcgcagaccuggaugagcgccgagggcgccuggcgccagguggagaagguggagacgugggccuuccgccaccccggguucaccauccucgcgcuguuccuggcccacuacaucggcaccucccucacccagaaggucgugaucuucauccugcugaugcucgugacgcccagcaugaccaugcggugcgucggggugggcaaccgcgacuucguggagggccuguccggggccaccugggucgacguggugcuggagcacggcgggugcgucaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccacccugcccgaggagcaggaccagaacuacgugugcaagcacaccuacgucgaccggggguggggcaacgggugcggccucuucgggaagggcucccuggugaccugcgccaaguuccagugccuggagcucacggagggcaaggugguccagcacgagaaccugaaguacaccgugaucaucaccgugcacaccggggaccagcaccaggucggcaacgagacgcagggggugaccgccgagaucacgccccaggccagcaccgucgaggcgaucuuccgcuccuacggcacccuggggcucgagugcagcccccggacgggccuggacuucaacgagaugauccugcucaccaugaagaacaaggccuggauggugcaccgccagugguucuucgaccugccccugccguggaccuccggcgccaccacggagacccccaccuggaacaagaaggagcuccuggugaccuucaagaacgcccacgccaagaagcaggaggucguggugcuggggagccaggagggcgcgaugcacacggcccucaccggggccaccgagauccagaccuccggcgggacgagcaucuucgccggccaccugaagugccggcugaagauggacaagcucgagcugaagggcauguccuacgccaugugcagcaacgcguucguccugaagaaggaggugagcgagacccagcacgggaccauccucaucaagguggaguacaagggcgaggacgcccccugcaagauccccuucuccaccgaggacgggcagggcaaggcccacaacggccgccugaucacggccaacccggucgugaccaagaaggaggagcccgugaacaucgaggcggagccgcccuucggggagagcaacaucaucaucggcaucggggacaaggcccugaagaucaacugguacaagaagggcuccagcaucgggaagauguucgaggccaccgcccggggcgcccgccggauggcgauccugggcgacaccgccugggacuucggguccgucggcggggugcucaacagccugggcaagauggugcaccagaucuucggguccgccuacacggcccuguucagcggcgucuccuggaucaugaagaucggcaucggggugcuccugaccuggaucggccugaacagcaagaacaccuccaugagcuucuccugcaucgugaucgggaucaucacccucuaccugggcgccgucgugcaggcggacauggggugcgugaucaacuggaagggcaaggagcugaagugcggcagcgggaucuucgucacgaacgaggugcacaccuggaccgagcaguacaaguuccaggccgacuccccgaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccgucguggugggggacaucaucggcauccucgagcagggcaagcgcacccugacgccccagcccauggagcugaaguacuccuggaagaccugggggaaggccaagaucgucaccgccgagacccagaacagcuccuucaucaucgacggccccaacacgccggagugccccaacgcgcuccgggccuggaacgugugggagguggaggacuacggguucggcgucuucaccaccaacaucuggcugaagcugcgcgagauguacacccagcucugcgaccaccggcugaugagcgccgccgugaaggacgagcgcgccgugcacgcggacaugggcuacuggaucgagagccagaagaacggguccuggaagcuggagaaggccagccucaucgaggucaagaccugcacguggcccaagucccacacccuguggagcaacggcgugcuggaguccgacaugaucauccccaagagccucgccgggccgaucucccagcacaacuaccggcccggcuaccacacccagaccgccgggcccuggcaccugggcaagcuggagcucgacuucaacuacugcgagggcacgaccguggucaucaccgagaacugcgggacccgcggcccgagccugcggacgaccaccguguccgggaagcugauccacgaguggugcugccgcagcugcacccugccgccccuccgguacaugggcgaggacgggugcugguacggcauggagauccgccccaucaacgagaaggaggagaacauggugaagucccuggucagcgccggcuccgggaagguggacaacuucacgaugggcgugcucugccuggcgauccuguucgaggaggucaugcgggggaaguucggcaagaagcacaugaucgccgggguccuguucaccuucgugcugcugcucagcggccagaucaccuggcgcgacauggcccggacccugaucaugaucggcuccaacgccagcgaccgcauggggaugggcgucacguaccuggcccucaucgcgaccuucaagauccagccguuccuggcccugggguucuuccuccggaagcugaccucccgcgagaaccugcuccugggcgugggccuggccauggccaccacgcuccagcugcccgaggacaucgagcagauggcgaacgggaucgcccugggccucauggcccugaagcugaucacccaguucgagaccuaccagcucugggccgcccuggugagccugaugugcagcaacaccaucuucacgcucaccgucgcguggcggaccgccacccugauccuggccgggaucucccuccugcccaugugccagagcuccagcaugcgcaagacggacuggcugcccaugaccguggccgccaugggcgugccgccccucccccuguucaucuucucccugaaggacacccucaagcgccggagcuggccccugaacgagggggucauggcggugggccuggucuccauccucgccagcucccugcugcgcaacgacgugccgauggccggcccccucguggccgggggccugcugaucgccugcuacgucaucaccgggacgagcgcggaccucaccguggagaaggccgccgacgugaccugggaggaggaggccgagcagaccggcgucucccacaaccugaugaucacgguggacgacgacgggaccaugcggaucaaggacgacgagaccgagaacauccugaccgugcuccugaagaccgcccugcucaucgucagcggcaucuuccccuacuccauccccgcgacgcugcugguguggcacaccuggcagaagcagacccagcgcagcggcgugcucugggacgucccgagcccgcccgagacccagaaggccgagcuggaggaggggguguaccggaucaagcagcagggcaucuucgggaagacccaggugggcgucggggugcagaaggagggcguguuccacaccauguggcacgucacccgcggcgccgugcugacccacaacgggaagcggcucgagcccaacugggccagcgugaagaaggaccugaucuccuacggcgggggcuggcgccugagcgcgcaguggcagaagggggaggagguccaggugaucgccguggagccgggcaagaaccccaagaacuuccagacgaugcccggcaucuuccagaccaccaccggggagaucggcgccaucgcccuggacuucaagcccgggacguccggcagcccgaucaucaaccgggagggcaaggucguggggcucuacggcaacgggguggucaccaagaacggcggguacgugagcggcaucgcccagaccaacgcggagcccgacggccccaccccggagcuggaggaggagauguucaagaagcgcaaccugacgaucauggaccuccaccccggguccggcaagacccggaaguaccugcccgccaucgugcgcgaggccaucaagcggcgccugcggacccucauccuggcccccacccgcgucguggccgcggagauggaggaggcccugaaggggcucccgauccgguaccagacgaccgccaccaagagcgagcacaccggcaaggagaucguggaccugaugugccacgccacguucaccaugcgccugcucucccccguccgggugcccaacuacaaccugaucaucauggacgaggcccacuucaccgaccccgcgagcaucgccgcccgcggguacaucuccacccgggugggcaugggcgaggccgcggccaucuucaugacggccaccccgcccgggaccgccgaggccuucccccagagcaacgcgcccauccaggacgaggagcgcgacaucccggagcgcuccuggaacagcggcaacgacuggaucaccgacuucgccgggaagacggucugguucgugcccuccaucaaggccggcaacgacaucgccaacugccugcggaagaacgggaagaaggugauccagcucagccgcaagaccuucgacaccgaguaccagaagaccaagcugaacgacugggacuucgucgugacgaccgacaucuccgagaugggcgccaacuucaaggcggaccgggugaucgacccccgccggugccugaagcccgucauccucaccgacggcccggagcgcgugauccuggccgggcccaugcccgugaccgucgccagcgccgcccagcggcgcggccggguggggcgcaacccccagaaggagaacgaccaguacaucuucacgggccagccgcugaacaacgacgaggaccacgcgcacuggaccgaggccaagaugcuccuggacaacaucaacacccccgaggggaucauccccgcccuguucgagcccgagcgggagaaguccgccgcgaucgacggcgaguaccgccucaagggcgagagccggaagaccuucguggagcugaugcgccgcggggaccugccggucuggcucgcccacaagguggccuccgagggcaucaaguacaccgaccgcaaguggugcuucgacggggagcggaacaaccagauccuggaggagaacauggacguggagaucuggacgaaggagggcgagaagaagaagcugcgcccccgguggcucgacgcccgcaccuacagcgacccccuggcccugaaggaguucaaggacuucgcggccggccgcaaguccaucgcccucgaccuggucaccgagaucgggcgggugcccccgcaccuggcccaccgcacccggaacgcccucgacaaccuggucaugcugcacacgagcgaguacggcgggcgcgcguaccggcacgccguggaggagcuccccgagaccauggagacccugcugcuccugggccugaugauccuccugaccgggggcgugaugcuguuccucaucuccggcaagggggucggcaagacgagcaucgggcugaucugcgugguggccagcuccggcaugcuguggauggccgacaucccccuccaguggaucgccagcgcgaucguccuggaguucuucaugauggugcugcucaucccggagcccgagaagcagcgcacgccccaggacaaccagcuggccuacguggucaucgggauccugacccucgccgccaucguggccgcgaacgagaugggccugcuggagaccacgaagcgggaccucggcauguccaaggagcccgggguggucagcccgaccuccuaccuggacguggaccugcaccccgccagcgccuggacccucuacgccguggcgaccacggucaucacccccaugcugcgccacaccaucgagaacuccaccgccaacgugagccuggccgccaucgccaaccaggcggugguccucaugggccuggacaagggguggcccaucuccaagauggaccugggcgugccgcuccuggcccuggggugcuacagccaggugaacccccucacgcugaccgccgccguccugcuccuggugacccacuacgccaucaucggccccggccugcaggcgaaggccacccgggaggcccagaagcgcacggccgccgggaucaugaagaaccccaccguggacggcaucaugaccaucgaccucgacccggucaucuacgacuccaaguucgagaagcagcugggccaggugaugcugcucgugcugugcgcgguccagcugcuccugaugcggaccagcugggccuucugcgaggcccugacgcucgccaccggccccaucaccacccugugggagggcucccccgggaaguucuggaacacgaccaucgcggugagcauggccaacaucuuccgcggcuccuaccuggccggggccggccucgccuucagcaucaugaaguccguggggaccggcaagcggggcaccgggagccagggcgagacgcugggggagaaguggaagaagaagcugaaccagcucucccgcaaggaguucgaccuguacaagaaguccggcaucaccgaggucgaccggaccgaggcgaaggaggggcugaagcgcggcgagaucacccaccacgccgugagccggggcagcgccaagcuccagugguucguggagcgcaacauggucauccccgaggggcgggugaucgaccugggcugcgggcgcggcggguggagcuacuacugcgccggccugaagaaggugaccgagguccggggcuacacgaagggcgggccggggcacgaggagcccgugcccauguccaccuacggcuggaacaucgugaagcucaucagcgggaaggacgucuucuaccugcccccggagaagugcgacacccugcugugcgacaucggcgaguccagccccucccccaccguggaggagagccgcacgauccgcgugcucaagauggucgagcccuggcugaagaacaaccaguucugcaucaaggugcugaacccguacaugcccgccgugaucgagcaccucgagcggcugcagcgcaagcacggcgggaugcugguccggaacccccucucccgcaacagcacccacgagauguacuggaucuccaacggcaccgggaacaucgugagcuccgugaacaugaucagccggcugcugcucaaccgcuucaccaugacguaccggcgccccaccaucgagaaggacgucgaccugggcgcgggcacccggcacgugaacgccgagccggagacccccaacauggacgugaucggggagcgcauccggcgcaucaaggaggagcacuccagcacguggcacuacgacgacgagaaccccuacaagaccugggccuaccacggcuccuacgaggucaaggccaccgggagcgccuccagcaugaucaacggcguggucaagcugcucaccaagccgugggacguggugcccacggucacccagauggcgaugaccgacaccacgcccuucgggcagcagcggguguucaaggagaagguggacacccgcacccccaagccgaugcccggcacccggaaggucauggagaucacggccgaguggcuguggcgcacccugggccggaacaagcgcccccggcucugcacccgcgaggaguucaccaagaaggugcgcacgaacgccgccaugggggcgguguucaccgaggagaaccagugggacagcgcccgggccgccgucgaggacgaggaguucuggaagcugguggaccgcgagcgggagcugcacaagcucggcaagugcggguccugcguguacaacaugaugggcaagcgcgagaagaagcugggggaguucggcaaggccaagggcagccgggcgaucugguacauguggcugggggcccgcuaccucgaguucgaggcccugggcuuccugaacgaggaccacugguucucccgggagaacagcuacuccggggucgagggcgaggggcuccacaagcugggcuacauccugcgcgacaucagcaagauccccggcggggccauguacgccgacgacaccgcgggcugggacacccggaucacggaggacgaccuccacaacgaggagaagaucacccagcagauggacccggagcaccgccagcuggccaacgccaucuucaagcugaccuaccagaacaagguggugaagguccagcggcccacccccaaggggacggugauggacaucaucucccgcaaggaccagcggggcagcggccagguggggaccuacggccucaacaccuucaccaacauggaggcccagcugauccgccagauggagggggagggcguccuguccaagaccgaccucgagaacccccaccuccuggagaagaagaucacgcaguggcucgagaccaaggggguggagcggcugaagcgcauggccaucagcggcgacgacugcguggucaagccgaucgacgaccgguucgcgaacgcccugcucgcccugaacgacaugggcaaggugcgcaaggacaucccccaguggcagcccuccaagggguggcacgacuggcagcagguccccuucugcagccaccacuuccacgagcugaucaugaaggacggccggaagcucgucgugccgugccgcccccaggacgagcugaucgggcgggcccgcaucucccagggcgccggguggagccugaaggagaccgcgugccucggcaaggccuacgcccagaugugggcccugauguacuuccaccgccgggaccugcgccucgcguccaacgccaucugcagcgccgugcccguccacugggugcccaccucccggacgaccuggagcauccacgcccaccaccaguggaugaccaccgaggacaugcugacgguguggaaccgcgucuggaucgaggacaacccguggauggaggacaagacccccgugaccaccugggaggacgugcccuaccugggcaagcgggaggaccaguggugcgggucccucaucggccugacgagccgcgccaccugggcgcagaacauccugaccgccauccagcagguccggagccucaucgggaacgaggaguuccuggacuacaugcccuccaugaagcgcuuccggaaggaggaggagagcgagggcgccaucugguga

SEQ ID NO: 9860 - RNA, 9873 nt, Artificial Sequence
  derived and/or modified CDS sequence (opt1) from DENV-3__JF808121__SS-prME
accucccugugccucaugaugauccugcccgccgcccuggcguuccaccucaccucccgcgacggggagccccggaugaucguggggaagaacgagcgcggcaagagccugcuguucaagaccgccuccgggaccaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcggcgccgggacaagcgcuccguggcccucgcgccccacgugggcauggggcuggacacccggacccagaccuggaugagcgccgagggcgccuggcgccagguggagaagguggagaccugggcccugcggcaccccggguucaccauccucgcgcuguuccuggcccacuacaucggcaccucccucacccagaagguggugaucuucauccugcugaugcucgucacccccagcaugaccaugcgcugcgugggggugggcaaccgggacuucgucgagggccuguccggggccaccuggguggacgugguccuggagcacggcgggugcgugacgaccauggccaagaacaagcccacccucgacaucgagcugcagaagaccgaggccacgcagcuggcgacccuccgcaagcugugcaucgagggcaagaucaccaacaucaccacggacagccggugccccacccagggcgaggccgugcugcccgaggagcaggaccagaacuacgucugcaagcacaccuacguggaccgcggguggggcaacgggugcggccucuucgggaagggcucccuggugaccugcgccaaguuccagugccuggagcucaucgagggcaaggucgugcaguacgagaaccugaaguacacggugaucaucaccguccacaccggggaccagcaccaggugggcaacgagacccagggggucacggccgagaucacgccccaggccagcaccaccgaggcgauccugcccgaguacggcacccucgggcuggagugcagcccccggacgggccuggacuucaacgagaugauccuccugaccaugaagaacaaggccuggauggugcaccgccagugguucuucgaccugccgcuccccuggaccagcggcgccaccacggagacccccaccuggaaccggaaggagcugcuggugaccuucaagaacgcccacgccaagaagcaggaggucguggugcucgggucccaggagggcgcgaugcacacggcccugaccggggccaccgagauccagaacagcggcgggaccuccaucuucagcggccaccugaagugccgccucaagauggacaagcuggagcugaagggcauguccuacgccaugugcacgaacaccuucguccucaagaaggaggugagcgagacccagcacgggaccauccugaucaagguggaguacaagggcgaggacgcccccugcaagaucccguucagcacggaggacgggcagggcaaggcgcacaacggccggcugaucaccgccaaccccgucgugaccaagaaggaggagcccgugaacaucgaggccgagcccccguucggggaguccaacaucgucaucggcaccggggacaacgcccugaagaucaacugguacaagaagggcagcuccaucgggaagauguucgaggcgacggcccgcggcgcccggcgcauggccauccucggcgacaccgccugggacuucgggagcgugggcggggugcugaacucccugggcaagaugguccaccagaucuucgggagcgcguacaccgcccucuucuccggcgugagcugggugaugaagaucggcaucgggguccugcugaccuggaucggccucaacuccaagaacacgagcauguccuucagcugcaucgccaucgggaucaucacccuguaccugggcgccguggugcaggccgacauggggugcgucaucaacuggaagggcaaggagcucaagugcggcuccgggaucuucgugaccaacgaggugcacaccuggacggagcaguacaaguuccaggcggacagccccaagcgccuggccaccgccaucgccggcgccugggagaacggggucugcggcauccgguccaccacccgcauggagaaccugcucuggaagcagaucgcgaacgagcugaacuacauccugugggagaacaacaucaagcucacggugguggucggggacaucaucggcgugcuggagcagggcaagcggacccugacgccccagcccauggagcucaaguacagcuggaagaccugggggaaggccaagaucgugacggccgagacccagaacuccagcuucaucaucgacggcccgaacacccccgagugccccuccgccagccgcgcguggaacgucugggagguggaggacuacggguucggcguguucaccaccaacaucuggcugaagcugcgggaggucuacacgcagcucugcgaccaccgccugaugagcgccgccgugaaggacgagcgggccgugcacgccgacaugggcuacuggaucgagucccagaagaacgggagcuggaagcuggagaaggcgucccucaucgaggucaagaccugcaccuggcccaagagccacacccugugguccaacggcgugcuggagagcgacaugaucaucccgaagucccucgccgggcccaucagccagcacaaccaccgccccggcuaccacacgcagaccgccgggccguggcaccugggcaagcuggagcucgacuucaacuacugcgagggcaccaccguggucaucacggagaacugcgggacccggggccccucccugcgcaccaccacggugagcgggaagcugauccacgaguggugcugccgguccugcacccugccgccccuccgcuacaugggcgaggacgggugcugguacggcauggagauccggccgaucagcgagaaggaggagaacauggugaagucccuggucagcgccggcuccgggaagguggacaacuucaccaugggcgugcucugccuggccauccuguucgaggaggucaugcgcgggaaguucggcaagaagcacaugaucgcggggguguucuucaccuucgugcuccugcugagcggccagaucacguggcgggacauggcccacacccucaccaugaucggcuccaacgccagcgaccgcauggggaugggcgucaccuaccuggcccugaucgccacguucaagauccagcccuuccucgcgcugggguucuuccugcggaagcucaccagccgcgagaaccugcugcucggcgugggccuggccauggccaccacccugcagcuccccgaggacaucgagcagauggccaacgggaucgcgcugggccugauggcccucaagcugaucacgcaguucgagaccuaccagcuguggaucgcccucaucucccugaccugcagcaacaccauguucacgcugaccguggccuggcggaccgccacccucauccuggcgggggucucccugcuccccgugugccagagcuccagcaugcgcaagacggacuggcugccgauggccgucgccgccaugggcgugccgccccugccccucuucaucuucucccugaaggacacccugaagcgccggagcuggccgcucaacgagggggugauggccgucggccugguguccauccuggcgagcucccuccugcgcaacgacgugcccauggccggcccccuggucgccgggggccuccugaucgccugcuacgugaucaccgggaccagcgccgaccugacgguggagaaggcggccgacaucaccugggaggaggaggccgagcagaccggcgucucccacaaccucaugaucaccguggacgacgacgggaccaugcggaucaaggacgacgagacggagaacauccugaccgugcugcucaagaccgcccugcugaucgucagcggcguguuccccuacuccaucccggccacccuccugguguggcacacguggcagaagcagacccagcgcagcggcguccugugggacgugcccagcccgcccgagacccagaaggcggagcucgaggaggggguguaccggaucaagcagcagggcaucuucgggaagacccaggucggcgugggggugcagaaggagggcgucuuccacacgauguggcacgugacccgcggcgccgugcugaccuacaacgggaagcggcuggagccgaacugggccagcgucaagaaggaccucaucuccuacggcgggggcuggcgccugagcgcccaguggcagaagggggaggagguccaggugaucgcggucgagcccggcaagaaccccaagaacuuccagaccaugcccggcacguuccagaccaccaccggggagaucggcgccaucgcccuggacuucaagccggggacgagcggcucccccaucaucaaccgggagggcaaggugguggggcuguacggcaacggggucgugaccaagaacggcggguacgugagcggcaucgcccagaccaacgccgagcccgacggcccgacccccgagcucgaggaggagauguucaagaagcgcaaccugacgaucauggaccugcaccccggguccggcaagacccggaaguaccuccccgcgaucguccgcgaggccaucaagcggcgccugcggacccugauccucgccccgacccgcgugguggccgccgagauggaggaggcgcugaaggggcugcccauccgguaccagacgaccgccaccaagagcgagcacaccggccgcgagaucgucgaccucaugugccacgccacguucaccaugcggcugcugucccccgugcgcgugcccaacuacaaccucaucaucauggacgaggcccacuucaccgacccggccagcaucgcggcccggggguacaucuccacccgcgucggcaugggcgaggccgccgcgaucuucaugacggccacgccgcccgggaccgccgacgccuucccccagagcaacgccccgauccaggacgaggagcgcgacauccccgagcgguccuggaacagcggcaacgaguggaucaccgacuucgcggggaagacggugugguucgugcccuccaucaaggccggcaacgacaucgccaacugccugcgcaagaacgggaagaaggucauccagcugagccggaagaccuucgacaccgaguaccagaagaccaagcucaacgacugggacuucguggugacgaccgacaucuccgagaugggcgccaacuucaaggccgaccgcgucaucgacccccggcgcugccugaagccggugauccugaccgacggccccgagcgggugauccucgcggggcccaugcccgucaccgccgccagcgccgcccagcgccggggccgcguggggcggaacccgcagaaggagaacgaccaguacaucuucaccggccagccccugaacaacgacgaggaccacgcgcacuggacggaggccaagaugcugcucgacaacaucaacacccccgaggggaucauccccgcccuguucgagccggagcgcgagaaguccgccgcgaucgacggcgaguaccggcugaagggcgagagccgcaagaccuucguggagcucaugcggcgcggggaccugcccgucuggcuggcccacaagguggccuccgagggcaucaaguacaccgaccggaaguggugcuucgacgggcagcgcaacaaccagauccucgaggagaacauggacgucgagaucuggacgaaggagggcgagaagaagaagcugcggccccgcuggcuggacgcccgcaccuacagcgacccccucgcccugaaggaguucaaggacuucgcggccggccggaaguccaucgcccuggaccucgugaccgagaucgggcgcgugccgagccaccuggcccaccggacccgcaacgcccuggacaaccucgucaugcugcacacgagcgagcacggcgggcgggcguaccgccacgccguggaggagcugcccgagaccauggagacccuccugcugcucggccugaugauccugcucaccgggggcgccaugcuguuccugaucuccggcaaggggaucggcaagacgagcaucgggcucaucugcgugaucgccuccagcggcaugcuguggauggccgagaucccccugcaguggaucgcguccgccaucguccucgaguucuucaugauggugcugcugaucccggagcccgagaagcagcggacgccccaggacaaccagcucgccuacguggucaucgggauccugacccuggccgccaucaucgcggccaacgagaugggccuccuggagaccacgaagcgcgaccugggcaugagcaaggagcccggggugguguccccgaccagcuaccucgacgucgaccugcaccccgccuccgccuggacccuguacgcgguggccaccacggugaucacccccaugcuccggcacaccaucgagaacagcaccgccaacgucucccuggccgccaucgcgaaccaggccguggugcugaugggccucgacaagggguggcccaucagcaagauggaccugggcgucccgcugcucgcccuggggugcuacucccaggugaacccccugacgcucaccgccgccgugcugcugcucaucacccacuacgcgaucaucggccccggccugcaggccaaggccacccgcgaggcccagaagcggacggccgcggggaucaugaagaaccccaccgucgacggcaucaugaccaucgaccuggacccggugaucuacgacagcaaguucgagaagcagcucggccaggugaugcugcugguccucugcgccgugcagcugcugcucaugcgcaccuccugggcccugugcgaggcccugacgcucgcgaccggccccaucaccacccugugggagggcagccccgggaaguucuggaacacgaccaucgccguguccauggccaacaucuuccggggcagcuaccuggccggggccggccucgcguucuccaucaugaaguccgucgggaccggcaagcgcggcaccgggagccagggcgagacccugggggagaaguggaagaagaagcugaaccagcucucccggaaggaguucgaccuguacaagaaguccggcaucacggagguggaccgcaccgaggccaaggaggggcugaagcggggcgagaucacccaccacgccgugagccgcggcagcgccaagcuccagugguucgucgagcggaacauggugauccccgaggggcgcgugaucgaccugggcugcgggcggggcgggugguccuacuacugcgccggccugaagaaggucaccgaggugcgcggcuacacgaagggcgggccggggcacgaggagcccgugcccaugagcaccuacggcuggaacaucgucaagcucauguccgggaaggacguguucuaccugcccccggagaagugcgacacccugcugugcgacaucggcgagagcucccccagccccaccguggaggagucccgcacgauccggguccucaagaugguggagcccuggcugaagaacaaccaguucugcaucaaggugcugaacccguacaugcccaccgucaucgagcaccucgagcgccugcagcggaagcacggcgggaugcuggugcgcaacccccucagccggaacuccacccacgagauguacuggaucagcaacggcaccgggaacaucguggcguccgucaacauggugagccgccugcugcucaaccgguucacgaugaagcaccgccggcccaccaucgagaaggacguggaccugggcgccggcacccgccacgucaacgccgagccggagacccccaacauggacgugaucggggagcggaucaagcgcaucaaggaggagcacaacuccacguggcacuacgacgacgagaaccccuacaagaccugggccuaccacggcagcuacgaggugaaggccaccggguccgcgagcagcaugaucaacggcgucgugaagcugcucaccaagccgugggacgucgugcccauggugacgcagauggccaugaccgacaccacccccuucgggcagcagcgggucuucaaggagaagguggacacgcgcacgccccgguccaugccgggcacccgccgggugaugggcaucaccgccgaguggcuguggaagacgcuggggcgcaacaagaagccccggcucugcccccgcgaggaguucaccaagaagguccgcaccaacgccgcgaugggcgccguguucaccgaggagaaccagugggacagcgccaaggccgccguggaggacgaggacuucuggaagcuggucgaccgggagcgcgagcugcacaagcucgggaagugcggcuccugcguguacaacaugauggggaagcgggagaagaagcugggcgaguucggcaaggcgaaggggagccgcgccaucugguacauguggcugggcgcccgguaccucgaguucgaggcccugggguuccugaacgaggaccacugguucucccgcgagaacagcuacuccggcguggagggggagggccuccacaagcugggcuacauccugcgggacaucagcaagauccccgggggcgccauguacgcggacgacacggccgggugggacacccgcaucaccgaggacgaccuccacaacgaggagaagaucacccagcagauggacccggagcaccggcagcuggccaacgccaucuucaagcugacguaccagaacaaggucgugaaggugcagcgccccacccccaccggcaccgucauggacaucaucucccggaaggaccagcgcggcagcggccaggugggcaccuacgggcucaacacguucaccaacauggaggcccagcugauccggcagauggagggcgagggggugcuguccaaggcggaccucgagaacccccaccuccccgagaagaagaucacccaguggcuggagaccaagggcgucgagcgccugaagcggauggccaucagcggcgacgacugcguggugaagcccaucgacgaccgcuucgccaacgcccugcuggcccucaacgacauggggaagguccggaaggacaucccccaguggcagcccuccaagggcuggcacgacuggcagcaggucccguucugcagccaccacuuccacgagcugaucaugaaggacgggcgcaagcuggugguccccugccggccccaggacgagcucaucggccgcgcgcggaucucccaggggagcggcuggucccugcgcgagacggccugccugggcaaggccuacgcccagauguggagccucauguacuuccaccgccgggaccugcgccuggcguccaacgccaucugcagcgccgugcccgugcacugggucccgaccagccggaugaccugguccauccacgcccaccaccaguggaugaccacggaggacaugcucaccguguggaaccgcguguggaucgaggacaaccccuggauggaggacaagacccccgucaccacgugggagaacgugcccuaccuggggaagcgggaggaccaguggugcggcagccugaucgggcucaccucccgcgccaccugggcgcagaacaucccgaccgccauccagcagguccggagccugaucggcaacgaggaguuccuggacuacaugcccuccaugaagcgcuuccggaaggaggaggagagcgagggggccaucugguga

SEQ ID NO: 9861 - RNA, 9873 nt, Artificial Sequence
  derived and/or modified CDS sequence (opt1) from DENV-3__JF808120__SS-prME
accagccugugccugaugaugauccugcccgccgcccuggcguuccaccucaccagccgcgacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaaggucgagacgugggcccugcggcaccccggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugcccgaggagcaggaccagaacuacgucugcaagcacaccuacguggaccgcggguggggcaacgggugcggccucuucgggaagggcucccuggugaccugcgccaaguuccagugccuggagcucaucgagggcaaggucgugcaguacgagaaccugaaguacaccgugaucaucacgguccacaccggggaccagcaccaggugggcaacgagacccagggggucaccgccgagaucacgccccaggccagcaccaccgaggcgauccugcccgaguacggcacccucgggcuggagugcagcccccggaccggccuggacuucaacgagaugauccuccugacgaugaagaacaaggccuggauggugcaccgccagugguucuucgaccugccgcuccccuggaccagcggcgccaccaccgagacgcccaccuggaaccggaaggagcugcuggugaccuucaagaacgcccacgccaagaagcaggaggucguggugcucgggucccaggagggcgcgaugcacaccgcccugacgggggccaccgagauccagaacagcggcgggaccuccaucuucgccggccaccugaagugccgccucaagauggacaagcuggagcugaagggcaugagcuacgccaugugcaccaacacguucguccucaagaaggagguguccgagacccagcacgggaccauccugaucaagguggaguacaagggcgaggacgcgcccugcaagaucccguucagcaccgaggacgggcagggcaaggcccacaacggccggcugaucacggccaaccccgucgugaccaagaaggaggagcccgugaacaucgaggccgagcccccguucggggagagcaacaucgucaucggcaccggggacaacgcgcugaagaucaacugguacaagaagggcuccagcaucgggaagauguucgaggccaccgcccgcggcgcccggcgcauggccauccucggcgacacggcgugggacuucggguccgugggcggggugcugaacagccugggcaagaugguccaccagaucuucggguccgccuacaccgcccucuucagcggcguguccugggugaugaagaucggcaucgggguccugcugaccuggaucggccucaacagcaagaacaccuccaugagcuucuccugcaucgccaucgggaucaucacgcuguaccugggcgccguggugcaggcggacauggggugcgucaucaacuggaagggcaaggagcucaagugcggcagcgggaucuucgugaccaacgaggugcacaccuggaccgagcaguacaaguuccaggccgacucccccaagcgccuggccacggccaucgccggcgcgugggagaacggggucugcggcauccggagcaccacccgcauggagaaccugcucuggaagcagaucgccaacgagcugaacuacauccugugggagaacaacaucaagcucaccgugguggucggggacaucaucggcgugcugaagcagggcaagcggacgcugacgccccagcccauggagcucaaguacuccuggaagaccugggggaaggccaagaucgugaccgccgagacgcagaacagcuccuucaucaucgacggcccgaacacccccgagugccccagcgcgucccgcgccuggaacgucugggagguggaggacuacggguucggcguguucaccaccaacaucuggcugaagcugcgggaggucuacacccagcucugcgaccaccgccugaugagcgccgccgugaaggacgagcgggccgugcacgcggacaugggcuacuggaucgagagccagaagaacggguccuggaagcuggagaaggccagccucaucgaggucaagacgugcaccuggcccaagucccacacccuguggagcaacggcgugcuggaguccgacaugaucauccccaagucccucgccgggcccaucucccagcacaaccaccgccccggcuaccacacccagacggccgggccguggcaccugggcaagcuggagcucgacuucaacuacugcgagggcaccaccguggucaucaccgagaacugcgggacgcggggccccagccugcgcaccaccaccguguccgggaagcugauccacgaguggugcugccggagcugcacgcugccgccccuccgcuacaugggcgaggacgggugcugguacggcauggagauccggccgaucuccgagaaggaggagaacauggucaagagccugguguccgccggcagcgggaagguggacaacuucaccaugggcgugcucugccuggcgauccuguucgaggaggucaugcgcgggaaguucggcaagaagcacaugaucgccgggguguucuucaccuucgugcuccugcuguccggccagaucaccuggcgggacauggcccacacgcucaucaugaucggcagcaacgccuccgaccgcauggggaugggcgucaccuaccuggcccugaucgcgaccuucaagauccagcccuuccucgcccugggguucuuccugcggaagcucaccagccgcgagaaccugcugcucggcgugggccuggccauggccacgacccugcagcuccccgaggacaucgagcagauggcgaacgggaucgcccugggccugauggcccucaagcugaucacccaguucgagaccuaccagcuguggacggcccucaucagccugaccugcuccaacaccauguucacccugacgguggccuggcggaccgcgacccucauccuggccggggucagccugcuccccgugugccaguccagcuccaugcgcaagaccgacuggcugccgauggccgucgccgccaugggcgugccgccccugccccucuucaucuucaaccugaaggacacgcugaagcgccggagcuggccgcucaacgagggggugauggcggucggccugguguccauccuggccagcucccuccugcgcaacgacgugcccauggccggcccccuggucgccgggggccuccugaucgccugcuacgugaucaccgggaccagcgcggaccugaccguggagaaggccgccgacaucacgugggaggaggaggccgagcagaccggcgucucccacaaccucaugaucaccguggacgacgacgggaccaugcggaucaaggacgacgagaccgagaacauccugacggugcugcucaagaccgcccugcugaucgucagcggcguguuccccuacuccaucccggcgacccuccugguguggcacaccuggcagaagcagacgcagcgcagcggcguccugugggacgugcccagcccgcccgagacccagaaggccgagcucgaggaggggguguaccggaucaagcagcagggcauccuggggaagacccaggucggcgugggggugcagaaggagggcgucuuccacaccauguggcacgugacgcgcggcgccgugcugaccuacaacgggaagcggcucgagccgaacugggccagcgucaagaaggaccugaucuccuacggcgggggcuggcgccugagcgcgcaguggcagaagggggaggagguccaggugaucgccgucgagcccggcaagaaccccaagaacuuccagaccaugcccggcaccuuccagacgaccaccggggagaucggcgccaucgcccuggacuucaagccggggaccuccggcagccccaucaucaaccgggagggcaaggugguggggcucuacggcaacggggucgugacgaagaacggcggguacgugagcggcaucgcccagaccaacgcggagcccgacggcccgacccccgagcuggaggaggagauguucaagaagcgcaaccugaccaucauggaccuccaccccggguccggcaagacgcggaaguaccugcccgccaucguccgcgaggccaucaagcggcgccugcggacccucauccuggccccgacccgcgugguggccgcggagauggaggaggcccugaaggggcuccccauccgguaccagaccacggccaccaagagcgagcacaccggccgcgagaucaucgaccugaugugccacgccaccuucacgaugcggcugcucucccccguccgcgugcccaacuacaaccugaucaucauggacgaggcccacuucaccgacccggcgagcaucgccgcccggggguacaucuccacccgcgugggcaugggcgaggccgcggccaucuucaugaccgccacgccgcccgggaccgccgacgccuucccccagagcaacgcgccgauccaggacgaggagcgcgacauccccgagcgguccuggaacagcggcaacgaguggaucaccgacuucgccgggaagaccgucugguucgugcccuccaucaaggccggcaacgacaucgccaacugccugcgcaagaacgggaagaaggugauccagcucagccggaagacguucgacaccgaguaccagaagaccaagcugaacgacugggacuucgucgugaccacggacaucuccgagaugggcgccaacuucaaggcggaccgcgugaucgacccccggcgcugccugaagccggucauccucaccgacggccccgagcgggugauccuggccgggcccaugcccgugaccgccgccagcgccgcgcagcgccggggccgcgucgggcggaacccgcagaaggagaacgaccaguacaucuucaccggccagccccugaacaacgacgaggaccacgcccacuggaccgaggccaagaugcuccuggacaacaucaacacgcccgaggggaucauccccgcccuguucgagccggagcgcgagaaguccgcggccaucgacggcgaguaccggcucaagggcgagagccgcaagaccuucguggagcugaugcggcgcggggaccugcccguguggcucgcccacaaggucgccuccgagggcaucaaguacaccgaccggaaguggugcuucgacgggcagcgcaacaaccagauccuggaggagaacauggacguggagaucuggaccaaggagggcgagaagaagaagcugcggccccgcuggcucgacgcccgcacguacagcgacccccuggcgcugaaggaguucaaggacuucgccgccggccggaaguccaucgcccucgaccuggucaccgagaucgggcgcgugccgagccaccuggcccaccggacccgcaacgcgcucgacaaccuggugaugcugcacaccuccgagcacggcgggcgggccuaccgccacgccgucgaggagcuccccgagacgauggagacccugcugcuccugggccugaugauccuccugaccgggggcgccaugcuguuccucaucagcggcaaggggaucggcaagaccagcaucgggcugaucugcgugaucgccuccagcggcaugcuguggauggcggagaucccccuccaguggaucgccuccgccaucgugcuggaguucuucaugaugguccugcucaucccggagcccgagaagcagcggacgccccaggacaaccagcuggccuacguggugaucgggauccugacccucgccgcgaucaucgccgccaacgagaugggccugcuggagaccaccaagcgcgaccucggcaugagcaaggagcccggggucguguccccgacgagcuaccuggacguggaccugcaccccgccuccgcguggacccucuacgccgucgccaccaccgugaucacgcccaugcugcggcacaccaucgagaacagcaccgccaacgugucccuggccgcgaucgccaaccaggccgucgugcucaugggccuggacaagggguggcccaucagcaagauggaccugggcgugccgcuccuggcccuggggugcuacucccaggucaacccccucacccugacggccgcggugcugcuccugaucacccacuacgccaucaucggccccggccugcaggccaaggccacccgcgaggcccagaagcggaccgcggccgggaucaugaagaaccccacgguggacggcaucaugaccaucgaccucgacccggucaucuacgacagcaaguucgagaagcagcugggccaggugaugcugcucgugcugugcgccguccagcugcuccugaugcgcaccuccugggcccugugcgaggcgcucacccuggccacgggccccaucaccacccugugggagggcagccccgggaaguucuggaacaccacgaucgccguguccauggccaacaucuuccggggcagcuaccucgccggggcgggccuggccuucuccaucaugaaguccguggggaccggcaagcgcggcaccgggucccagggcgagacccugggggagaaguggaagaagaagcucaaccagcugagccggaaggaguucgaccuguacaagaaguccggcaucaccgaggucgaccgcacggaggccaaggaggggcucaagcggggcgagaucacccaccacgccgugucccgcggcagcgccaagcugcagugguucguggagcggaacauggucauccccgaggggcgcgugaucgaccugggcugcgggcggggcgggugguccuacuacugcgcgggccucaagaaggugaccgagguccgcggcuacaccaagggcgggccggggcacgaggagcccgugcccaugacgaccuacggcuggaacaucgugaagcugaugagcgggaaggacgucuucuaccugcccccggagaagugcgacacccugcucugcgacaucggcgaguccagccccucccccaccguggaggagagccgcacgauccgggugcugaagauggucgagcccuggcugaagaacaaccaguucugcaucaaggugcucaacccguacaugcccaccgugaucgagcaccuggagcgccugcagcggaagcacggcgggaugcucguccgcaacccccugucccggaacagcacccacgagauguacuggaucuccaacggcaccgggaacaucguggccagcgugaacauggucucccgccugcuccugaaccgguucacgaugacccaccgccggcccaccaucgagaaggacguggaccugggcgccggcacccgccacgugaacgccgagccggagacgcccaacauggacgucaucggggagcggaucaagcgcaucaaggaggagcacaacagcaccuggcacuacgacgacgagaaccccuacaagaccugggccuaccacggcuccuacgaggugaaggcgaccgggagcgccuccagcaugaucaacggcguggucaagcuccugacgaagccgugggacgugguccccauggugacccagauggccaugaccgacaccacgcccuucgggcagcagcggguguucaaggagaaggucgacacccgcacgccccgguccaugccgggcacccgccgggugaugggcaucaccgccgaguggcuguggcgcacccucgggcggaacaagaagccccgccugugcacccgcgaggaguucaccaagaaggugcggacgaacgcggccaugggcgccgucuucaccgaggagaaccagugggacagcgccaaggccgcgguggaggacgaggacuucuggaagcugguggaccgcgagcgggagcuccacaagcuggggaagugcggcagcugcgucuacaacaugauggggaagcgcgagaagaagcugggcgaguucggcaaggccaaggggucccgggccaucugguacauguggcucggcgcccgcuaccuggaguucgaggcccugggguuccucaacgaggaccacugguucagccgggagaacuccuacagcggcguggagggggagggccugcacaagcugggcuacauccuccgcgacaucuccaagauccccgggggcgcgauguacgccgacgacaccgccgggugggacacccggaucacggaggacgaccugcacaacgaggagaagaucacccagcagauggaccccgagcaccgccagcuggccaacgccaucuucaagcucaccuaccagaacaagguggucaaggugcagcggccgacccccaccggcacggugauggacaucaucagccgcaaggaccagcggggcuccgggcaggucggcaccuacgggcugaacaccuucaccaacauggaggcgcagcugauccgccagauggagggcgagggggugcucagcaaggccgaccuggagaacccccaccuccccgagaagaagaucacgcaguggcucgagaccaagggcguggagcggcugaagcgcauggccaucuccggcgacgacugcgucgugaagccgaucgacgaccgguucgccaacgcccugcucgcgcugaacgacauggggaaggugcgcaaggacaucccccaguggcagcccagcaagggcuggcacgacuggcagcagguccccuucugcucccaccacuuccacgagcugaucaugaaggacgggcggaagcucguggugccgugccgcccccaggacgagcugaucggccgggcccgcaucagccagggguccggcuggagccugcgcgagaccgccugccucggcaaggccuacgcgcagauguggucccugauguacuuccaccggcgcgaccugcggcucgccagcaacgccaucugcuccgccguccccgugcacugggugcccaccagccgcacgaccugguccauccacgcccaccaccaguggaugaccaccgaggacaugcugacggucuggaaccggguguggaucgaggacaacccguggauggaggacaagacccccgugaccaccugggagaacguccccuaccuggggaagcgcgaggaccaguggugcggcagccucaucgggcugacgagccgggcgaccugggcccagaacauccccaccgccauccagcagguccgcucccugaucggcaacgaggaguuccucgacuacaugccgagcaugaagcgguuccgcaaggaggaggaguccgagggggccaucugguga

SEQ ID NO: 9862 - RNA, 9873 nt, Artificial Sequence
  derived and/or modified CDS sequence (opt1) from DENV-3__JF808119__SS-prME
accagccugugccucaugaugauccugcccaccgcccuggccuuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgcggagggcgccuggcgccagguggagaaggucgagaccugggcccugcgccacccgggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacaucaccacggacagccgcugccccacccagggcgaggcggugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggccauccugcccgaguacggcacccuggggcucgagugcuccccgcgcacgggccuggacuucaacgagaugauccugcucaccaugaagaacaaggcguggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgccaugcacacggcgcucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgccccgugcaagauccccuucagcacggaggacgggcagggcaaggcgcacaacggccgccugaucaccgccaaccccgucgugaccaagaaggacgagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcaggucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgcggggguguucuucauguucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccauguucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucagccucaaggacacccugaagcgccgcuccuggccccugaacgagggggucauggccgugggccucgugagcauccuggcguccagccugcuccggaacgacguccccauggccggcccccugguggccgggggccugcucaucgccugcuacgugaucacggggaccuccgccgaccugaccgucgagaaggcggccgacaucaccugggaggaggaggccgagcagacgggcgugagccacaaccugaugaucaccguggacgacgacgggaccaugcgcaucaaggacgacgagaccgagaacauccucaccguccugcugaagacggcccuccugaucguguccggcguguucccguacagcauccccgccacccugcucgucuggcacaccuggcagaagcagacccagcgguccggcgugcugugggacgugcccagcccgcccgagacgcagaaggcggagcuggaggagggggucuaccgcaucaagcagcagggcaucuucgggaagacccaggugggcguggggguccagaaggagggcguguuccacaccauguggcacgugacccggggcgccguccucacguacaacgggaagcgccuggagcccaacugggccuccgugaagaaggaccugaucagcuacggcgggggcuggcggcucuccgcccaguggcagaagggggaggaggugcaggucaucgcgguggagcccggcaagaaccccaagaacuuccagaccaugcccggcaccuuccagaccacgaccggggagaucggcgccaucgcccuggacuucaagcccgggaccagcggcagccccaucaucaaccgcgagggcaagguggucgggcuguacggcaacgggguggugaccaagaacggcggguacgucuccggcaucgcccagacgaacgccgagccggacggccccacccccgagcuggaggaggagauguucaagaagcggaaccucaccaucauggaccugcaccccgggagcggcaagacccgcaaguaccugccggcgaucgugcgggaggccaucaagcgccggcuccgcacgcugauccuggcccccacccggguggucgccgccgagauggaggaggcgcucaaggggcugcccauccgcuaccagaccaccgccacgaaguccgagcacaccggccgggagaucguggaccugaugugccacgccaccuucaccaugcgccuccugagccccgugcgggucccgaacuacaaccugaucaucauggacgaggcccacuucacggaccccgccuccaucgcggcccgcggguacaucagcacccgggugggcaugggcgaggccgccgcgaucuucaugaccgccacgccgcccgggacggccgacgccuucccgcaguccaacgcccccauccaggacgaggagcgcgacauccccgagcgcagcuggaacuccggcaacgaguggaucaccgacuucgcggggaagaccgugugguucguccccagcaucaaggccggcaacgacaucgccaacugccuccggaagaacgggaagaaggugauccagcugucccgcaagaccuucgacacggaguaccagaagaccaagcugaacgacugggacuucguggucaccaccgacaucagcgagaugggcgccaacuucaaggccgaccgggugaucgacccgcgccggugccucaagcccgugauccugacggacggccccgagcgcgucauccuggcggggcccaugccggugaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagacguucgucgagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcccucaaggaguucaaggacuucgcggccggccgcaagagcaucgcccuggaccuggugacggagaucgggcggguccccucccaccucgcccaccgcacccggaacgcccuggacaaccuggugaugcuccacaccagcgagcacggcgggcgcgcguaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgcgagcgccaucgugcuggaguucuucaugauggugcuccugauccccgagcccgagaagcagcgcacgccccaggacaaccagcuggccuacgucgugaucgggauccucacgcuggccgccaucaucgcggccaacgagaugggccugcucgagaccaccaagcgggaccugggcauguccaaggagccggggguggucagccccaccuccuaccuggacguggaccuccaccccgccagcgccuggacgcuguacgcgguggccaccaccgucaucacccccaugcugcgccacacgaucgagaacuccaccgccaacgugagccucgccgccaucgcgaaccaggccgugguccugaugggccuggacaagggguggccgaucuccaagauggaccucggcgugccccugcuggcccucgggugcuacagccaggugaacccccugacccugaccgccgccguccuccugcugaucacgcacuacgcgaucaucggccccggccuccaggccaaggccacccgggaggcccagaagcgcaccgccgcggggaucaugaagaacccgaccguggacggcaucaugacgaucgaccuggaccccgugaucuacgacuccaaguucgagaagcagcuggggcaggucaugcuccuggugcugugcgccgugcagcuccugcugaugcggaccagcugggcccucugcgaggcccugacccuggcgaccggccccaucacgacccucugggagggcucccccgggaaguucuggaacaccaccaucgccgucagcauggccaacaucuuccgcggcuccuaccuggccggggccggccuggcguucagcaucaugaaguccguggggacgggcaagcggggcaccgggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagacgacccaccacgccgucagccggggcuccgccaagcugcagugguucguggagcgcaacauggugaucccggaggggcgggucaucgaccucggcugcgggcgcggcggguggagcuacuacugcgccggccugaagaaggugaccgaggugcggggcuacaccaagggcgggcccgggcacgaggagcccguccccauguccacguacggcuggaacaucaucaagcugaugagcgggaaggacguguucuaccucccgcccgagaagugcgacacccugcugugcgacaucggcgaguccagccccucccccaccguggaggagagccgcaccauccgcguccugaagaugguggagccguggcucaagaacaaccaguucugcaucaagauccugaaccccuacaugcccacggugaucgagcaccuggagcggcuccagcgcaagcacggcgggaugcugguccggaacccccugucccgcaacagcacccacgagauguacuggaucuccaacggcaccgggaacaucguggcgagcgugaacauggucucccggcuccugcugaaccgcuucaccaugacgcaccggcgcccgaccaucgagaaggacguggaccucggcgccggcacccggcacgugaacgccgagcccgagacccccaacauggacgucaucggggagcgcaucaagcggaucaaggaggagcacaacagcacguggcacuacgacgacgagaacccguacaagaccugggccuaccacggcuccuacgaggugaaggccaccgggagcgcguccagcaugaucaacggcguggucaagcugcugaccaagcccugggacgugguccccauggugacgcagauggccaugaccgacaccacccccuucgggcagcagcgcguguucaaggagaaggucgacacgcggaccccgcgcagcaugcccggcacccggcgcgugaugggcaucaccgccgaguggcucuggcggacgcuggggcgcaacaagaagccccggcugugcacccgcgaggaguucaccaagaaggugcgcaccaacgccgcgaugggcgccgucuucacggaggagaaccagugggacuccgccaaggccgccguggaggacgaggacuucuggaagcucguggaccgggagcgcgagcugcacaagcuggggaagugcggcagcugcgucuacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgcggacgacaccgccgggugggacacccgcaucaccgaggacgaccugcacaacgaggagaagaucacgcagcagauggacccggagcaccggcagcucgccaacgccaucuucaagcugaccuaccagaacaagguggucaaggugcagcgccccacccccaccggcaccgugauggacaucaucagccggaaggaccagcgcggcuccgggcaggucggcacguacgggcugaacaccuucaccaacauggaggcccagcucauccggcagauggagggcgagggggugcugagcaaggcggaccuggagaacccccaccucccggagaagaagaucacccaguggcuggagacgaagggcguggagcgccugaagcggauggccaucuccggcgaggacugcguccucaagcccaucgacgaccgcuucgacaacgcccugcuggcccucaacgacauggggaaggugcggaaggacaucccccaguggcagcccagcaagggcuggcacgacuggcagcaggucccguucugcucccaccacuuccacgagcugaucaugaaggacgggcgcaagcuggucgugcccugccggccccaggacgagcucaucggccgcgcccggaucagccagggggcgggcuggucccugcgcgagaccgccugccugggcaaggccuacgcccagauguggagccucauguacuuccaccgccgggaccugcgccuggcguccaacgccaucugcagcgccgugcccguccacugggugccgaccucccggaccacguggagcauccacgcccuccaccaguggaugaccaccgaggacaugaucaccguguggaaccgcgucuggaucgaggacaaccccuggauggaggacaagacgcccgugaccaccugggaggacgugcccuaccuggggaagcgggaggaccaguggugcggcagccugaucgggcucaccucccgcgccacgugggcgcagaacaucccgaccgccauccagcagguccggagccugaucggcaacgaggaguuccuggacuacaugcccuccaugaagcgcuuccggaaggaggaggagagcgagggggccaucugguga

SEQ ID NO: 9863 - RNA, 9873 nt, Artificial Sequence
  derived and/or modified CDS sequence (opt1) from DENV-3__JF808118__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggugaucuucauccugcugaugcucgugacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgauccuccgcaagcugugcaucgagggcaagaucacgaacaucaccaccgacagccggugccccacccagggcgaggccgugcugccggaggagcaggaccagaacuacgucugcaagcacacguacguggaccgcggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggccagcacgaccgaggcgauccugcccgaguacggcacccuggggcucgagugcuccccgcggaccggccuggacuucaacgagaugauccugcucaccaugaagaacaaggccuggauggugcaccgccagugguucuucgaccugccccugcccuggacgagcggcgccaccaccgagacccccacguggaaccggaaggagcuccuggugaccuucaagaacgcccacgccaagaagcaggaggucguggugcuggggucccaggagggcgcgaugcacaccgcccucaccggggccacggagauccagaacagcggcgggaccuccaucuucgccggccaccugaagugccgccugaagauggacaagcucgagcugaagggcaugagcuacgccaugugcaccaacaccuucguccugaagaaggagguguccgagacgcagcacgggaccauccucaucaagguggaguacaagggcgaggacgcgccgugcaagauccccuucagcaccgaggacgggcagggcaaggcccacaacggccggcugaucaccgccaaccccgucgugacgaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccgcggcgcccggcgcauggccauccugggcgacaccgcgugggacuucggguccgugggcggggugcucaacagccugggcaagaugguccaccagaucuucggguccgccuacaccgcccuguucagcggcguguccugggugaugaagaucggcaucgggguccuccugacguggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugaccaacgaggugcacacguggaccgagcaguacaaguuccaggccgacucccccaagcgccucgccaccgccaucgccggcgcgugggagaacggggucugcggcauccggagcaccacgcgcauggagaaccugcuguggaagcagaucgccaacgagcucaacuacauccugugggagaacaacaucaagcugaccgugguggucggggacaucaucggcgugcucgagcagggcaagcggacccugacgccccagccgauggagcugaaguacuccuggaagacgugggggaaggccaagaucgugaccgccgagacccagaacagcuccuucaucaucgacggccccaacacccccgagugccccagcgcgucccgcgccuggaacgucugggagguggaggacuacggguucggcguguucacgaccaacaucuggcucaagcugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagaccugcaccuggccgaagucccacacgcucuggagcaacggcgugcuggaguccgacaugaucauccccaagagccuggccgggcccaucucccagcacaaccaccgcccgggcuaccacacccagaccgccgggcccuggcaccucggcaagcuggagcuggacuucaacuacugcgagggcaccacgguggucaucaccgagaacugcgggacccggggccccagccuccgcaccacgaccguguccgggaagcugauccacgaguggugcugccggagcugcacccugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgcgauccuguucgaggaggucaugcgcgggaaguucggcaagaagcacaugaucgccgggguguucuucacguucgugcugcuccuguccggccagaucaccuggcgggacauggcccacacccugaucaugaucggcagcaacgccuccgaccgcauggggaugggcgucaccuaccucgcccugaucgcgacguucaagauccagcccuuccuggcccucggguucuuccugcggaagcugaccagccgcgagaaccuccugcugggcgugggccucgccauggccaccacccugcagcugcccgaggacaucgagcagauggcgaacgggaucgcccucggccugauggcccugaagcucaucacgcaguucgagaccuaccagcuguggaccgcccugaucagccugaccugcuccaacacgauguucacccugaccguggccuggcggaccgcgacgcugauccucgccggggucagccugcugccggugugccaguccagcuccaugcgcaagaccgacuggcuccccauggccgucgccgccaugggcgugccgccccucccgcuguucaucuucagccucaaggacacccugaagcgccgguccuggccccugaacgagggggugauggcggucggccucgugagcauccuggccuccagccugcuccgcaacgacgugcccauggccggcccccuggucgccgggggccugcucaucgccugcuacgugaucaccgggacguccgcggaccugaccguggagaaggccgccgacaucaccugggaggaggaggccgagcagaccggcgucagccacaaccugaugaucacgguggacgacgacgggaccaugcggaucaaggacgacgagaccgagaacauccucaccgugcugcugaagaccgcccuccugaucgucuccggcguguucccguacagcauccccgcgacgcugcucguguggcacaccuggcagaagcagacccagcgcuccggcguccugugggacgugcccagcccgcccgagacccagaaggccgagcuggaggaggggguguaccggaucaagcagcagggcaucuucgggaagacgcaggucggcgugggggugcagaaggagggcgucuuccacaccauguggcacgugacccgcggcgccgugcucaccuacaacgggaagcggcuggagcccaacugggccuccgucaagaaggaccugaucagcuacggcgggggcuggcgccucuccgcgcaguggcagaagggggaggagguccaggugaucgccgucgagcccggcaagaaccccaagaacuuccagacgaugcccggcaccuuccagaccaccacgggggagaucggcgccaucgcccuggacuucaagcccgggaccagcggcagccccaucaucaaccgggagggcaaggugguggggcuguacggcaacggggucgugaccaagaacggcggguacguguccggcaucgcccagaccaacgcggagccggacggccccacgcccgagcuggaggaggagauguucaagaagcgcaaccucaccaucauggaccugcaccccgggagcggcaagacccggaaguaccugccggccaucguccgcgaggccaucaagcggcgccuccggacccugauccuggcccccacgcgcgugguggccgcggagauggaggaggcccucaaggggcugcccauccgguaccagaccaccgccaccaaguccgagcacacgggccgcgagaucgucgaccugaugugccacgccaccuucaccaugcggcuccugagccccgugcgcgugccgaacuacaaccugaucaucauggacgaggcccacuucaccgaccccgcguccaucgccgcccggggguacaucagcacgcgcgucggcaugggcgaggccgcggccaucuucaugaccgccacgccgcccgggaccgccgacgccuucccgcaguccaacgcgcccauccaggacgaggagcgcgacauccccgagcggagcuggaacuccggcaacgaguggaucacggacuucgccgggaagaccgugugguucgugcccagcaucaaggccggcaacgacaucgccaacugccuccgcaagaacgggaagaaggucauccagcugucccggaagaccuucgacaccgaguaccagaagacgaagcugaacgacugggacuucguggugaccaccgacaucagcgagaugggcgccaacuucaaggcggaccgcgucaucgacccgcggcgcugccucaagcccgugauccugaccgacggccccgagcgggugauccuggccgggcccaugccggucacggccgccuccgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagucccgcaagaccuucguggagcugaugcggcgcggggaccuccccgucuggcuggcccacaagguggccagcgagggcaucaaguacacggaccggaaguggugcuucgacgggcagcgcaacaaccagauccuggaggagaacauggacgucgagaucuggaccaaggagggcgagaagaagaagcuccggccccgcuggcuggacgcccgcaccuacuccgacccgcuggcgcucaaggaguucaaggacuucgccgccggccgcaagagcaucgcccuggaccuggugaccgagaucgggcgcgugcccucccaccucgcccaccggacgcgcaacgcgcuggacaaccuggucaugcuccacaccagcgagcacggcgggcgggccuaccgccacgccguggaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugcucuggauggcggagaucccgcugcaguggaucgccagcgccaucguccuggaguucuucaugauggugcuccugauccccgagcccgagaagcagcggacgccccaggacaaccagcuggccuacguggucaucgggauccucacccuggccgcgaucaucgccgccaacgagaugggccugcucgagacgaccaagcgcgaccugggcauguccaaggagccggggguggugagccccaccuccuaccuggacgucgaccuccaccccgccagcgcguggacccuguacgccguggccacgaccgugaucacccccaugcugcggcacaccaucgagaacuccacggccaacgucagccucgccgcgaucgccaaccaggccguggugcugaugggccuggacaagggguggccgaucuccaagauggaccucggcgucccccugcuggcccucgggugcuacagccaggugaacccccugacccugaccgccgcggugcuccugcugaucacccacuacgccaucaucggccccggccuccaggccaaggccacgcgcgaggcccagaagcggaccgcggccgggaucaugaagaacccgaccgucgacggcaucaugaccaucgaccuggaccccgugaucuacgacuccaaguucgagaagcagcugggccaggugaugcuccugguccugugcgccgugcagcuccugcugaugcgcacgagcugggcccucugcgaggcgcugacccuggccaccggccccaucaccacgcucugggagggcucccccgggaaguucuggaacaccaccaucgccgugagcauggccaacaucuuccggggcuccuaccuggccggggcgggccuggccuucagcaucaugaaguccgucgggaccggcaagcgcggcacggggagccagggcgagacccucggggagaaguggaagaagaagcugaaccagcugagccggaaggaguucgaccucuacaagaaguccggcaucaccgagguggaccgcaccgaggccaaggaggggcugaagcggggcgagaccacgcaccacgccgugagccgcggcuccgccaagcugcagugguucgucgagcggaacauggugaucccggaggggcgcgugaucgaccucggcugcgggcggggcggguggagcuacuacugcgcgggccugaagaaggucaccgaggugcgcggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccggguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacgcacgagauguacuggaucuccaacggcaccgggaacaucguggccagcgucaacauggugucccgccuccugcugaaccgguucaccaugacccaccgccggccgacgaucgagaaggacguggaccucggcgccggcacccgccacgucaacgccgagcccgagacccccaacauggacgugaucggggagcggaucaagcgcaucaaggaggagcacaacagcaccuggcacuacgacgacgagaacccguacaagacgugggccuaccacggcuccuacgaggugaaggcgaccgggagcgccuccagcaugaucaacggcgucgugaagcugcugaccaagcccugggacgucgugcccauggugacccagauggccaugacggacaccacccccuucgggcagcagcgggucuucaaggagaagguggacacccgcacgccgcggagcaugcccggcacccgccgggugaugggcaucaccgccgaguggcucuggcgcacccuggggcggaacaagaagccccgccugugcacgcgcgaggaguucaccaagaagguccggaccaacgcggccaugggcgccguguucaccgaggagaaccagugggacuccgccaaggccgcgguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgcgauguacgccgacgacacggccgggugggacacccggaucaccgaggacgaccugcacaacgaggagaagaucacccagcagauggacccggagcaccgccagcucgccaacgccaucuucaagcugacguaccagaacaaggucgugaaggugcagcggcccacccccaccggcaccgucauggacaucaucagccgcaaggaccagcggggcuccggccaggugggcaccuacgggcugaacacguucaccaacauggaggcgcagcucauccgccagauggagggcgagggggugcugagcaaggccgaccuggagaacccccaccucccggagaagaagaucacccaguggcuggagaccaagggcgucgagcggcugaagcgcauggccaucuccggcgacgacugcguggugaagcccaucgacgaccgguucgccaacgcccuccuggcgcugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggccggcuggucccuccgcgagacggccugccugggcaaggcguacgcccagauguggagccugauguacuuccaccggcgcgaccuccggcuggccuccaacgccaucugcagcgccgugcccgugcacugggucccgaccucccgcaccaccuggagcauccacgcgcaccaccaguggaugacgaccgaggacaugcugaccguguggaaccggguguggaucgaggacaaccccuggauggaggacaagacccccgucacgaccugggagaacgugcccuaccucgggaagcgcgaggaccaguggugcggcagccugaucgggcugaccucccgggccaccugggcccagaacaucccgacggccauccagcagguccgcagccucaucggcaacgaggaguuccuggacuacaugcccuccaugaagcgguuccgcaaggaggaggagagcgagggggccaucugguga

SEQ ID NO: 9864 - RNA, 9873 nt, Artificial Sequence
  derived and/or modified CDS sequence (opt1) from DENV-3__JF808127__SS-prME
accagccugugccucaugaugauccugcccgccgcccuggcguuccaccucaccagccgggacggcgagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcggcggcgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggugaucuucauccugcugaugcucgugacgcccagccugaccaugcgcugcgugggggugggcaaccgggacuucgucgagggccuguccggggccaccuggguggacgugguccucgagcacggcgggugcgugaccacgauggccaagaacaagcccacccuggacaucgagcugcagaagaccgaggccacccagcucgcgacgcugcgcaagcugugcaucgagggcaagaucaccaacaucaccaccgacagccggugccccacgcagggcgaggccgugcucccggaggagcaggaccagaacuacgucugcaagcacaccuacguggaccgcggguggggcaacgggugcggccuguucgggaagggcucccuggugaccugcgccaaguuccagugccucgagcccaucgagggcaaggucgugcaguacgagaaccugaaguacaccgugaucaucacgguccacaccggggaccagcaccaggugggcaacgagacccagggggucaccgccgagaucacgccccaggccagcaccaccgaggcgauccugcccgaguacggcacccucgggcuggagugcuccccgcggaccggccuggacuucaacgagaugauccuccugacgaugaagaacaaggccuggauggugcaccgccagugguucuucgaccugccccuccccuggaccagcggcgccaccaccgagacgcccaccuggaaccggaaggagcugcuggugaccuucaagaacgcccacgccaagaagcaggaggucguggugcucgggucccaggagggcgcgaugcacaccgcccugacgggggccaccgagauccagaacagcggcgggaccuccaucuucgccggccaccugaagugccgccucaagauggacaagcuggagcugaagggcaugagcuacgccaugugcaccaacacguucguccucaagaaggagguguccgagacccagcacgggaccauccugaucaagguggaguacaagggcgaggacgcgccgugcaagauccccuucagcaccgaggacgggcagggcaaggcccacaacggccggcugaucacggccaaccccgucgugaccaagaaggaggagcccgugaacaucgaggccgagccgcccuucggggagagcaacaucgucaucggcaccggggacaacgcgcugaagaucaacugguacaagaagggcuccagcaucgggaagauguucgaggccaccgcccgcggcgcccggcgcauggccauccucggcgacacggcgugggacuucggguccgugggcggggugcugaacagccugggcaagaugguccaccagaucuucggguccgccuacaccgcccucuucagcggcguguccugggugaugaagaucggcaucgggguccugcugaccuggaucggccucaacagcaagaacaccuccaugagcuucuccugcaucgccaucgggaucaucacgcuguaccugggcgccguggugcaggcggacauggggugcgucaucaacuggaagggcaaggagcucaagugcggcagcgggaucuucgugaccaacgaggugcacaccuggaccgagcaguacaaguuccaggccgacucccccaagcgccuggccacggccaucgccggcgcgugggagaacggggucugcggcauccggagcaccacccgcauggagaaccugcucuggaagcagaucgccaacgagcugaacuacauccugugggagaacaacaucaagcucaccgugguggucggggacaucaucggcgugcuggagcagggcaagcggacgcugacgccccagccgauggagcucaaguacuccuggaagaccugggggaaggccaagaucgugaccgccgagacgcagaacagcuccuucaucaucgacggccccaacacccccgagugccccagcgcgucccgcgccuggaacgucugggagguggaggacuacggguucggcguguucaccaccaacaucuggcugaagcugcgggaggucuacacccagcucugcgaccaccgccugaugagcgccgccgugaaggacgagcgggccgugcacgcggacaugggcuacuggaucgagagccagaagaacggguccuggaagcuggagaaggccagccucaucgaggucaagacgugcaccuggccgaagucccacacccuguggagcaacggcgugcuggaguccgacaugaucauccccaagagccucgccgggcccaucucccagcacaaccaccgcccgggcuaccacacccagacggccgggcccuggcaccugggcaagcuggagcucgacuucaacuacugcgagggcaccaccguggucaucaccgagaacugcgggacgcggggccccagccugcgcaccaccaccguguccgggaagcugauccacgaguggugcugccggagcugcacgcugccgccccugcgcuacaugggcgaggacgggugcugguacggcauggagauccggcccaucuccgagaaggaggagaacauggucaagagccuggucuccgccggcagcgggaagguggacaacuucaccaugggcgugcucugccuggcgauccuguucgaggaggucaugcgcgggaaguucggcaagaagcacaugaucgccgggguguucuucaccuucgugcuccugcuguccggccagaucaccuggcgggacauggcccacacgcucaucaugaucggcagcaacgccuccgaccgcauggggaugggcgucaccuaccuggcccugaucgcgaccuucaagauccagcccuuccucgcccugggguucuuccugcggaagcucaccagccgcgagaaccugcugcucggcgugggccuggccauggccacgacccugcagcuccccgaggacaucgagcagauggcgaacgggaucgcccugggccugauggcccucaagcugaucacccaguucgagaccuaccagcuguggacggcccucaucagccugaccugcuccaacaccauguucacccugacgguggccuggcggaccgcgacccucauccuggccggggucagccugcuccccgugugccaguccagcuccaugcgcaagaccgacuggcugcccauggccgucgccgccaugggcgugccgccccucccccuguucaucuucagccugaaggacacgcugaagcgccgguccuggccccucaacgagggggugauggcggucggccuggugagcauccuggccuccagccuccugcgcaacgacgugcccauggccggcccccuggucgccgggggccuccugaucgccugcuacgugaucaccgggaccuccgcggaccugaccguggagaaggccgccgacaucacgugggaggaggaggccgagcagaccggcgucagccacaaccucaugaucaccguggacgacgacgggaccaugcggaucaaggacgacgagaccgagaacauccugacggugcugcucaagaccgcccugcugaucgucuccggcguguucccguacagcauccccgcgacccuccugguguggcacaccuggcagaagcagacgcagcgcuccggcguccugugggacgugcccuccccgcccgagacccagaaggccgagcucgaggaggggguguaccggaucaagcagcagggcaucuucgggaagacccaggucggcgugggggugcagaaggagggcgucuuccacaccauguggcacgugacgcgcggcgccgugcugaccuacaacgggaagcggcuggagcccaacugggccuccgucaagaaggaccucaucagcuacggcgggggcuggcgccuguccgcgcaguggcagaagggggaggagguccaggugaucgccgucgagcccggcaagaaccccaagaacuuccagaccaugccgggcaccuuccagacgaccaccggggagaucggcgccaucgcccuggacuucaagcccgggaccagcggcagccccaucaucaaccgggagggcaaggugguggggcuguacggcaacggggucgugacgaagaacggcggguacguguccggcaucgcccagaccaacgcggagccggacggccccacccccgagcucgaggaggagauguucaagaagcgcaaccugaccaucauggaccugcaccccgggagcggcaagacgcggaaguaccucccggccaucguccgcgaggccaucaagcggcgccugcggacccugauccucgcccccacccgcgugguggccgcggagauggaggaggcccugaaggggcugcccauccgguaccagaccacggccaccaaguccgagcacaccggccgcgagaucgucgaccucaugugccacgccaccuucacgaugcggcugcugagccccgugcgcgugccgaacuacaaccucaucaucauggacgaggcccacuucaccgaccccgcguccaucgccgcccggggguacaucagcacccgcgucggcaugggcgaggccgcggccaucuucaugaccgccacgccgcccgggaccgccgacgccuucccgcaguccaacgcgcccauccaggacgaggagcgcgacauccccgagcggagcuggaacuccggcaacgaguggaucaccgacuucgccgggaagaccgugugguucgugcccagcaucaaggccggcaacgacaucgccaacugccugcgcaagaacgggaagaaggucauccagcugucccggaagacguucgacaccgaguaccagaagaccaagcucaacgacugggacuucguggugaccacggacaucagcgagaugggcgccaacuucaaggcggaccgcgucaucgacccgcggcgcugccugaagcccgugauccugaccgacggccccgagcgggugauccucgccgagcccaugccggucaccgccgccuccgccgcgcagcgccgggggcgcgugggccggaacccccagaaggagaacgaccaguacaucuucaccgggcagccccugaacaacgacgaggaccacgcccacuggaccgaggccaagaugcugcucgacaacaucaacacgcccgagggcaucaucccggcccuguucgagcccgagcgcgagaaguccgcggccaucgacggggaguaccggcugaagggcgagucccgcaagaccuucguggagcucaugcggcgcggcgaccugcccgucuggcuggcccacaagguggccagcgaggggaucaaguacaccgaccggaaguggugcuucgacggccagcgcaacaaccagauccucgaggagaacauggacgucgagaucuggaccaaggagggggagaagaagaagcugcggccccgcuggcuggacgcccgcacguacuccgacccgcucgcgcugaaggaguucaaggacuucgccgccggccgcaagagcaucgcccuggaccucgugaccgagaucggccgcgugcccucccaccuggcccaccggacccgcaacgcgcuggacaaccucgucaugcugcacaccagcgagcacgggggccgggccuaccgccacgccguggaggagcugcccgagacgauggagacccuccugcugcucgggcugaugauccugcucaccggcggggccaugcuguuccugaucagcggcaagggcaucgggaagaccuccaucggccucaucugcgugaucgccagcuccgggaugcuguggauggcggagaucccgcugcaguggaucgccagcgccaucguccucgaguucuucaugauggugcugcugauccccgagcccgagaagcagcggacgccccaggacaaccagcucgccuacguggucaucggcauccugacccuggccgcgaucaucgccgccaacgagauggggcuccuggagaccaccaagcgcgaccugggcauguccaaggagccgggcguggugagccccacguccuaccucgacgucgaccugcaccccgccagcgcguggacccuguacgccguggccaccaccgugaucacgcccaugcuccggcacaccaucgagaacuccaccgccaacgucagccuggccgcgaucgccaaccaggccguggugcugauggggcucgacaagggcuggccgaucuccaagauggaccugggggucccccugcucgcccugggcugcuacagccaggugaacccccugacccucacggccgcggugcugcugcucaucacccacuacgccaucaucgggcccggccugcaggccaaggccacccgcgaggcccagaagcggaccgcggccggcaucaugaagaacccgacggucgacgggaucaugaccaucgaccuggaccccgugaucuacgacuccaaguucgagaagcagcucggccaggugaugcugcugguccucugcgccgugcagcugcugcucaugcgcaccagcugggcccugugcgaggcgcugacccucgccacggggcccaucaccacccugugggagggcucccccggcaaguucuggaacaccacgaucgccgugagcauggccaacaucuuccggggguccuaccuggccggcgcggggcucgccuucagcaucaugaaguccgucggcaccgggaagcgcggcaccggcagccagggggagacccugggcgagaaguggaagaagaagcugaaccagcucagccggaaggaguucgaccugaacaagaaguccgggaucaccgagguggaccgcacggaggccaaggagggccugaagcgcggggagaucacccaccacgccgugagccgcggcuccgccaagcuccagugguucgucgagcggaacauggugaucccggagggccgcgugaucgaccuggggugcggccgcgggggcuggagcuacuacugcgcggggcugaagaaggucaccgaggugcgcggcuacaccaagggcgggcccggccacgaggagcccgugcccauguccacguacggguggaacaucgucaagcucaugagcggcaaggacguguucuaccugccgcccgagaagugcgacacccugcugugcgacaucggggaguccagccccucccccaccguggaggagagccgcaccauccggguccucaagaugguggagccguggcugaagaacaaccaguucugcaucaaggugcugaaccccuacaugcccacggucaucgagcaccucgagcgccugcagcggaagcacggcggcaugcuggugcgcaacccccucucccggaacagcacccacgagauguacuggaucuccaacgggaccggcaacaucguggccagcgucaagauggugucccgccugcugcucaaccgguucaccaugacgcaccgccggccgaccaucgagaaggacguggaccugggggccggcacccgccacgucaacgccgagcccgagacccccaacauggacgugaucggcgagcggaucaagcgcaucaaggaggagcacaacagcacguggcacuacgacgacgagaacccguacaagaccugggccuaccacggguccuacgaggugaaggcgaccggcagcgccuccagcaugaucaacggggucgugaagcugcucaccaagcccugggacgucgugcccauggugacgcagauggccaugaccgacaccacccccuucggccagcagcgggucuucaaggagaagguggacacgcgcaccccgcggagcaugcccgggacccgccgggugaugggcaucaccgccgaguggcuguggcgcacgcugggccggaacaagaagcccaagcucugcacccgcgaggaguucaccaagaagguccgcaccaacgcggccaugggggccguguucacggaggagaaccagugggacuccgccaaggccgcgguggaggacgaggacuucuggaagcuggucgaccgggagcgcgagcugcacaagcucggcaagugcgggagcugcguguacaacaugaugggcaagcgggagaagaagcugggggaguucggcaaggccaagggcucccgcgccaucugguacauguggcugggggcccgguaccucgaguucgaggcccugggcuuccugaacgaggaccacugguucagccgcgagaacuccuacagcgggguggagggcgaggggcuccacaagcugggcuacauccugcgggacaucuccaagauccccggcggggcgauguacgccgacgacaccgccggcugggacacccgcaucaccgaggacgaccuccacaacgaggagaagaucacgcagcagauggacccggagcaccggcagcuggccaacgccaucuucaagcugaccuaccagaacaaggucgugaaggugcagcgccccacccccaccgggaccgucauggacaucaucagccggaaggaccagcgcggcuccggccagguggggacguacggccucaacaccuucaccaacauggaggcgcagcugauccggcagauggagggggagggcgugcugagcaaggccgaccucgagaacccccaccucccggagaagaagaucacccaguggcuggagacgaagggggucgagcgccucaagcggauggccaucuccggcgacgacugcguggugaagcccaucgacgaccgcuucgccaacgcccugcuggcgcucaacgacaugggcaagguccggaaggacaucccccaguggcagcccagcaagggguggcacgacuggcagcaggucccguucugcucccaccacuuccacgagcugaucaugaaggacggccgcaagcuggugguccccugccggccccaggacgagcucaucgggcgcgcccggaucagccagggcgccggguggucccugcgcgagaccgccugccugggcaaggcguacgcccagauguggagccucauguacuuccaccgccgggaccugcgccuggccuccaacgccaucugcagcgccgugcccgugcacugggucccgaccucccggaccacguggagcauccacgcgcaccaccaguggaugaccaccgaggacaugcucaccguguggaaccgcguguggaucgaggacaaccccuggauggaggacaagacgcccgucaccaccugggagaacgugcccuaccugggcaagcgggaggaccaguggugcgggagccugaucggccucaccucccgcgccacgugggcccagaacaucccgaccgccauccagcagguccggagccugaucgggaacgaggaguuccuggacuacaugcccuccaugaagcgcuuccggaaggaggaggagagcgagggcgccaucugguga

SEQ ID NO: 9865 - RNA, 9873 nt, Artificial Sequence
  derived and/or modified CDS sequence (opt1) from DENV-3__JF808124__SS-prME
accagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcggcgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcaccuucgggcuggagugcuccccgcggaccggccucgacuucaacgagaugauccugcugacgaugaagaacaaggccuggauggugcaccgccagugguucuucgaccucccccugcccuggaccagcggcgccaccaccgagacgcccaccuggaaccggaaggagcugcucgugaccuucaagaacgcccacgccaagaagcaggaggucguggugcuggggucccaggagggcgcgaugcacaccgcccugacgggggccaccgagauccagaacagcggcgggaccuccaucuucgccggccaccucaagugccgccugaagauggacaagcuggagcucaagggcaugagcuacgccaugugcaccaacacguucguccugaagaaggagguguccgagacccagcacgggaccauccugaucaagguggaguacaagggcgaggacgcgccgugcaagauccccuucagcaccgaggacgggcagggcaaggcccacaacggccggcucaucacggccaaccccgucgugaccaagaaggaggagcuggugaacaucgaggccgagcccccguucggggagagcaacaucgucaucggcaucggggacaacgcgcugaagaucaacugguacaagaagggcuccagcaucgggaagauguucgaggccaccgcccgcggcgcccggcgcauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccggagcacgacccgcauggagaaccugcuguggaagcagguggccaacgagcucaacuacauccugugggagaacaacaucaagcugaccguggucgugggggacaucaucggcgugcucgagcagggcaagcggacccugacgccccagcccauggagcugaaguacuccuggaagaccugggggaaggccaagaucgucaccgccgagacccagaacagcuccuucaucaucgacggcccgaacacgcccgagugccccagcgcgucccgcgccuggaacgugugggagguggaggacuacggguucggcgucuucaccaccaacaucuggcucaagcugcgggagguguacacccagcugugcgaccaccgccucaugagcgccgccgugaaggacgagcgggccguccacgcggacaugggcuacuggaucgagagccagaagaacggguccuggaagcuggagaaggccagccugaucgaggugaagaccugcacguggcccaagucccacacccucuggagcaacggcgugcuggaguccgacaugaucaucccgaagagccuggccgggcccaucucccagcacaaccaccgccccggcuaccacacccagaccgccgggccguggcaccucggcaagcuggagcuggacuucaacuacugcgagggcacgaccgucgugaucaccgagaacugcgggacccggggccccagccuccgcacgaccaccguguccgggaagcugauccacgaguggugcugccggagcugcacccugcccccccuccgcuacaugggcgaggacgggugcugguacggcauggagauccggccgaucuccgagaaggaggagaacauggucaagagccugguguccgccggcagcgggaagguggacaacuucacgaugggcguccugugccucgcgauccuguucgaggaggugaugcgcgggaaguucggcaagaagcacaugaucgccggggugcuguucaccugcguccuccugcuguccggccagaucaccuggcgggacauggcccacacccucaucaugaucggcagcaacgccuccgaccgcauggggaugggcgugacguaccuggcccugaucgcgaccuucaagauccagcccuuccucgcccugggguucuuccugcggaagcucaccagccgcgagaaccugcugcucggcgugggccuggccauggccaccacgcugcagcuccccgaggacaucgagcagauggggaacggcaucgcgcuggggcugauggcccucaagcugaucacccaguucgagaccuaccagcuguggaccgcccucaucagccugacgugcuccaacaccauguucacccugaccgucgccuggcggacggccacccucauccuggcgggcgugagccugcuccccgucugccaguccagcuccaugcgcaagaccgacuggcugccgauggccguggccgccaugggggugcccccccugccccucuucaucuucagccugaaggacacccugaagcgccgguccuggccgcucaacgagggcgucauggccgugggccuggugagcauccuggcguccagccuccugcgcaacgacguccccauggccgggccccugguggccggcgggcuccugaucgccugcuacgugaucacgggcaccuccgccgaccugaccgucgagaaggcggccgacaucaccugggaggaggaggccgagcagacgggggugagccacaaccucaugaucaccguggacgacgacggcaccaugcggaucaaggacgacgagaccgagaacauccugaccguccugcucaagacggcccugcugauccucuccggcguguuccccuacagcaucccggccacccugcugguguggcacaccuggcagaagcagacccagcgcuccgggguccucugggacgugcccagcccccccgagacgcagaaggcggagcuggaggagggcguguaccggaucaagcagcaggggaucuucggcaagacccaggucggggugggcgugcagaaggagggcgucuuccacaccauguggcacgugacccgcggggccgugcugacguacaacggcaagcggcucgagccgaacugggccuccgucaagaaggaccugaucagcuacgggggcggguggcgccuguccgcccaguggcagaagggcgaggaggugcaggugaucgcggucgagcccggcaagaaccccaagaacuuccagaccaugcccgggaccuuccagaccacgaccggcgagaucggggccaucgcccuggacuucaagccgggcaccagcggcagccccaucaucaaccgggaggggaagguggugggccucuacgggaacggcgucgugaccaagaacgggggcuacguguccggcaucgcccagacgaacgccgagcccgacgggccgacccccgagcuggaggaggagauguucaagaagcgcaaccugaccaucauggaccuccaccccggcagcgggaagacccggaaguaccugcccgcgaucguccgcgaggccaucaagcggcgccugcggacgcucauccuggccccgacccgcgugguggccgccgagauggaggaggcgcugaagggccuccccauccgguaccagaccaccgccacgaaguccgagcacaccgggcgcgagaucgucgaccugaugugccacgccaccuucaccaugcggcugcucagccccgugcgcgugcccaacuacaaccugaucaucauggacgaggcccacuucacggacccggccuccaucggcgcgcggggcuacaucagcacccgcgucgggaugggcgaggccgccgccaucuucaugaccgcgaccccccccgggacggccgacgccuucccccaguccaacgccccgauccaggacgaggagcgcgacauccccgagcggagcuggaacuccggcaacgaguggaucaccgacuucgccgggaagaccgugugguucgugcccagcaucaaggcgggcaacgacaucgccaacugccugcgcaagaacggcaagaaggucauccagcucucccggaagaccuucgacacggaguaccagaagaccaagcugaacgacugggacuucguggugaccaccgacaucagcgagaugggggccaacuucaaggccgaccgcgucaucgacccccggcgcugccugaagccggugauccucacggacggccccgagcgggugauccuggccgggcccaugcccgucaccgcggccuccgccgcccagcgccggggccgcguggggcggaacccgcagaaggagaacgaccaguacaucuucaccggccagccccugaacaacgacgaggaccacgcccacuggaccgaggcgaagaugcuccuggacaacaucaacacccccgagggcaucauccccgcccuguucgagccggagcgcgagaagagcgccgccaucgacggggaguaccggcucaagggcgagucccgcaagacguucguggagcugaugcggcgcggggaccugcccgucuggcucgcgcacaagguggccagcgagggcaucaucuacaccgaccggaaguggugcuucgacggccagcgcaacaaccagauccuggaggagaacauggacgucgagaucuggaccaaggagggggagaagaagaagcugcggccccgcuggcucgacgcccgcaccuacuccgacccccuggcccugaaggaguucaaggacuucgccgcgggccggaagagcaucgcccucgaccuggugacggagaucgggcgcgugccgucccaccuggcccaccggacccgcaacgcccucgacaaccuggucaugcugcacaccagcgagcacggcgggcgggccuaccgccacgcgguggaggagcuccccgagaccauggagacgcugcugcuccugggccugaugauccuccugaccggcggggccaugcuguuccucaucagcggcaaggggaucggcaagaccuccaucgggcugaucugcgugaucgccagcuccggcaugagcuggauggccgagaucccccugcaguggaucgccuccgcgaucguccucgaguucuucaugauggugcugcugaucccggagcccgagaagcagcggaccccccaggacaaccagcucgccuacguggucaucggcauccugacgcuggccgccaucaucgccgcgaacgagauggggcuccuggagaccaccaagcgcgaccugggcaugagcaaggagcccggggugguguccccgaccagcuaccucgacgucgaccugcaccccgccuccgccuggacgcuguacgccguggcgaccaccgugaucacccccaugcuccggcacacgaucgagaacagcaccgccaacgucucccuggccgccaucgccaaccaggcgguggugcugaugggccucgacaagggguggcccaucagcaagauggaccugggcgucccgcugcucgcccugggcugcuacucccaggugaacccccugacccucaccgccgccgugcugcugcucaucacgcacuacgccaucaucgggcccggccugcaggcgaaggccacccgcgaggcccagaagcggaccgccgccgggaucaugaagaaccccaccgucgacggcaucaugacgaucgaccuggacccggugaucuacgacagcaaguucgagaagcagcucggccaggugaugcugcugguccucugcgcggugcagcugcugcucaugcgcaccuccugggcccugugcgaggcccugacccucgccaccgggcccaucacgacccugugggagggcagccccgggaaguucuggaacaccaccaucgcgguguccauggccaacaucuuccggggcagcuaccuggccggggccggccucgccuucuccaucaugaagagcgucggcacggggaagcgcggcaccgggagccagggcgagacccugggggagaaguggaagaagaagcugaaccagcucucccggaaggaguucgaccuguacaagaagagcggcaucaccgagguggaccgcaccgaggcgaaggagggccugaagcggggggagaucacgcaccacgccgugucccgcggcagcgccaagcuccagugguucgucgagcggaacauggugauccccgaggggcgcgugaucgaccugggcugcgggcggggcggcugguccuacuacugcgccgggcugaagaaggucaccgaggugcgcggcuacaccaaggggggcccggggcacgaggagcccgugcccaugagcaccuacggcuggaacaucgucaagcucauguccggcaaggacguguucuaccugcccccggagaagugcgacacgcugcugugcgacaucggggagagcucccccagccccaccguggaggagucccgcaccauccggguccucaagaugguggagcccuggcugaagaacaaccaguucugcaucaaggugcugaacccguacaugcccaccgucaucgagcaccucgagcgccugcagcggaagcacggcgggaugcuggugcgcaacccccucagccggaacuccacgcacgagauguacuggaucagcaacggcaccggcaacaucguggccuccgucaacauggugagccgccugcugcucaaccgguucaccaugacccaccgccggcccacgaucgagaaggacguggaccugggggcgggcacccgccacgucaacgccgagccggagacccccaacauggacgugaucggggagcggaucaagcgcaucaaggaggagcacaacuccaccuggcacuacgacgacgagaaccccuacaagacgugggccuaccacggcagcuacgaggugaaggccaccggguccgccagcagcaugaucaacggcgucgugaagcugcucaccaagccgugggacgucgugcccauggugacccagauggcgaugacggacaccacccccuucggccagcagcgggucuucaaggagaagguggacacccgcacgccccgguccaugccggggacccgccgggugaugggcaucaccgccgaguggcuguggcgcacccuggggcggaacaagaagccccgccucugcacgcgcgaggaguucaccaagaagguccggaccaacgccgccaugggcgcgguguucaccgaggagaaccagugggacagcgccaaggccgccguggaggacgaggacuucuggaagcuggucgaccgcgagcgggagcugcacaagcucgggaagugcggcuccugcguguacaacaugaugggcaagcgcgagaagaagcugggggaguucggcaaggccaaggggagccgggcgaucugguacauguggcugggcgcccgcuaccucgaguucgaggcccugggguuccugaacgaggaccacugguucucccgggagaacagcuacuccggcguggagggcgaggggcuccacaagcugggcuacauccugcgcgacaucagcaagauccccgggggcgccauguacgccgacgacacggcgggcugggacacccggaucaccgaggacgaccuccacaacgaggagaagaucacccagcagauggaccccgagcaccgccagcuggccaacgccaucuucaagcugacguaccagaacaaggucgugaaggugcagcggccgacccccaccgggaccgucauggacaucaucucccgcaaggaccagcggggcagcgggcaggugggcaccuacgggcucaacacguucaccaacauggaggcccagcugauccgccagauggagggcgagggcgugcuguccaaggccgaccucgagaacccccaccugcccgagaagaagaucacccaguggcuggagaccaagggggucgagcggcucaagcgcauggcgaucagcggcgacgacugcguggugaagccgaucgacgaccgguucgccaacgcccugcuggcccucaacgacauggggaagguccgcaaggacaucccccaguggcagcccuccaagggcuggcacgacuggcagcaggugcccuucugcagccaccacuuccacgagcugaucaugaaggacgggcggaagcugguggucccgugccgcccccaggacgagcucaucggccgggcccgcaucucccagggcgcgggguggagccugcgcgagacggccugccugggcaaggccuacgcccagauguggucccucauguacuuccaccggcgcgaccugcggcuggcgagcaacgccaucugcuccgccgugcccgugcacuggguccccaccagccgcaccaccuggagcauccacgcccaccaccaguggaugacgaccgaggacaugcucaccguguggaaccggguguggaucgaggacaacccguggauggaggacaagacccccgucacgaccugggagaacgugcccuaccuggggaagcgcgaggaccaguggugcggcucccugaucgggcucaccagccgggccaccugggcgcagaacauccccacggccauccagcaggugcgcucccugaucggcaacgaggaguuccuggacuacaugccgagcaugaagcgguuccgcaaggaggaggaguccgagggcgccaucugguga

SEQ ID NO: 9866 - RNA, 9873 nt, Artificial Sequence
  derived and/or modified CDS sequence (opt1) from DENV-3__JF808126__SS-prME
accagccugugccucaugaugauccugcccgccgcccuggcguuccaccucaccagccgggacggggagccgcggaugaucguggggaagaacgagcggggcaagagccugcuguucaagaccgccagcgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgggacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucacgcugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggcgacccuccggaagcugugcaucgagggcaagaucaccaacaucaccacggacagccgcugccccacccagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccgcaggccagcaccaccgaggcgauccugcccgaguacggcacccuggggcucgagugcuccccgcgcacgggccuggacuucaacgagaugauccugcucaccaugaagaacaaggccuggauggugcaccggcagugguuccuggaccugccccuccccuggaccagcggcgccaccacggagacccccaccuggaaccgcaaggagcugcuggugaccuucaagaacgcccacgccaagaagcaggaggucguggugcucgggucccaggagggcgcgaugcacacggcccugaccggggccaccgagauccagaacagcggcgggaccuccaucuucgccggccaccugaagugccggcucaagauggacaagcuggagcugaagggcaugagcuacgccaugugcacgaacaccuucguccucaagaaggagguguccgagacccagcacgggaccauccugaucaagguggaguacaagggcgaggacgcgccgugcaagauccccuucagcacggaggacgggcagggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccucggcgacacggcgugggacuucggguccgugggcggggugcugaacagccugggcaagaugguccaccagaucuucggguccgccuacaccgcccucuucagcggcguguccugggugaugaagaucggcaucgggguccugcugaccuggaucggccucaacagcaagaacaccuccaugagcuucuccugcaucgccaucgggaucaucacgcuguaccugggcgccguggugcaggcggacauggggugcgucaucaacuggaagggcaaggagcucaagugcggcagcgggaucuucgugaccaacgaggugcacaccuggaccgagcaguacaaguuccaggccgacucccccaagcgccuggccacggccaucgccggcgcgugggagaacggggucugcggcauccgcagcaccacccggauggagaaccugcucuggaagcagaucgccaacgagcugaacuacauccugugggagaacaacaucaagcucaccgugguggucggggacaucaucggcgugcuggagcagggcaagcgcacgcugacgccccagccgauggagcucaaguacuccuggaagaccuggggcaagagcaagaucgugaccgccgagacgcagaacuccagcuucaucaucgacggccccaacacccccgagugccccuccgccagccgggcguggaacgucugggagguggaggacuacggguucggcguguucaccaccaacaucuggcugaagcugcgcgaggucuacacccagcucugcgaccaccggcugaugagcgccgccgugaaggacgagcgcgccgugcacgccgacaugggcuacuggaucgagucccagaagaacgggagcuggaagcuggagaaggcgucccucaucgaggucaagacgugcaccuggcccaagagccacacccugugguccaacggcgugcuggagagcgacaugaucauccccaagucccucgccgggcccaucagccagcacaaccaccggccgggcuaccacacccagacggccgggcccuggcaccugggcaagcuggagcucgacuucaacuacugcgagggcaccaccguggucaucaccgagaacugcgggacgcgcggccccgcccugcggaccaccaccguguccgggaagcugauccacgaguggugcugccgcagcugcacgcugccgccccugcgguacaugggcgaggacgggugcugguacggcauggagauccgccccaucuccgagaaggaggagaacauggucaagagccuggucuccgccggcagcgggaagguggacaacuucaccaugggcgugcucugccuggcgauccuguucgaggaggucaugcgggggaaguucggcaagaagcacaugaucgccgggguguucuucaccuucgugcuccugcuguccggccagaucaccuggcgcgacauggcccacacgcucaucaugaucggcagcaacgccuccgaccggauggggaugggcgucaccuaccuggcccugaucgcgaccuucaagauccagcccuuccucgcccugggguucuuccugcgcaagcucaccagccgggagaaccugcugcucggcgugggccuggccauggccacgacccugcagcuccccgaggacaucgagcagauggcgaacgggaucgcccugggccugauggcccucaagcugaucacccaguucgagaccuaccagcuguggacggcccucaucagccugaccugcuccaacaccauguucacccugacgguggccuggcgcaccgcgacccucauccuggccggggucagccugcuccccgugugccaguccagcuccaugcggaagaccgacuggcugcccauggccgucgccgccaugggcgugccgccccucccccuguucaucuucagccugaaggacacgcugaagcgccgcuccugcccccucaacgagggggugauggcggucggccuggugagcauccuggccuccagccuccugcggaacgacgugcccauggccggcccccuggucgccgggggccuccugaucgccugcuacgugaucaccgggaccuccgcggaccugaccguggagaaggccgccgacaucacgugggaggaggaggccgagcagaccggcgucagccacaaccucaugaucaccguggacgacgacgggaccaugcgcaucaaggacgacgagaccgagaacauccugacggugcugcucaagaccgcccugcugaucgucuccggcguguucccguacagcauccccgcgacccuccugguguggcacaccuggcagaagcagacgcagcgguccggcguccugugggacgugcccuccccgcccgagacccagaaggccgagcucgaggaggggguguaccgcaucaagcagcagggcaucuucgggaagacccaggucggcgugggggugcagaaggagggcgucuuccacaccauguggcacgugacgcggggcgccgugcugaccuacaacgggaagcgccuggagcccaacugggccuccgucaagaaggaccucgugagcuacggcgggggcuggcggcuguccgcgcaguggcagaagggggaggaggugcaggucaucgccguggagcccggcaagaaccccaagaacuuccagaccaugccgggcaccuuccagacgaccaccggggagaucggcgccaucgcccuggacuucaagcccgggaccagcggcagccccaucaucaaccgcgagggcaagguggucgggcuguacggcaacgggguggugacgaagaacggcggguacgucuccggcaucgcccagaccaacgcggagccggacggccccacccccgagcucgaggaggagauguucaagaagcggaaccugaccaucauggaccugcaccccgggagcggcaagacgcgcaaguaccucccggccaucgugcgggaggccaucaagcgccggcugcgcacccugauccucgcccccacccggguggucgccgcggagauggaggaggcccugaaggggcugcccauccgcuaccagaccacggccaccaaguccgagcacaccggccgggagaucguggaccucaugugccacgccaccuucacgaugcgccugcugagccccgugcggguccagaacuacaaccucaucaucauggacgaggcccacuucaccgacccggcguccaucgccgcccgcggguacaucagcacccgggugggcaugggcgaggccgcggccaucuucaugaccgccacgccgcccgggaccgccgacgccuucccccaguccaacgcgccgauccaggacgaggagcgcgacauccccgagcgcagcuggaacuccggcaacgaguggaucaccgacuucgccgggaagaccgugugguucguccccagcaucaaggccggcaacgacaucgccaacugccugcggaagaacgggaagaaggugauccagcugucccgcaagacguucgacaccgaguaccagaagaccaagcucaacgacugggacuucguggucaccacggacaucagcgagaugggcgccaacuucaaggcggaccgggugaucgacccccgccggugccugaagccggugauccugaccgacggccccgagcgcgucauccucgccgggcccaugcccgugaccgccgccuccgccgcgcagcggcgcggccggguggggcgcaacccgcagaaggagaacgaccaguacaucuucaccggccagccccugaacaacgacgaggaccacgcccacuggaccgaggccaagaugcugcucgacaacaucaacacgcccgaggggaucauccccgcccuguucgagccggagcgggagaaguccgcggccaucgacggcgaguaccgccugaagggcgagucccggaagaccuucgucgagcucaugcgccgcggggaccugcccguguggcuggcccacaaggucgccagcgagggcaucaaguacaccgaccgccgguggugcuucgacgggcagcgcaacaaccagauccucgaggagaacauggacguggagaucuggaccaaggagggcgagaagaagaagcugcggccccgcuggcuggacgcccgcacguacuccgacccccucgcgcugaaggaguucaaggacuucgccgccggccgcaagagcaucgcccuggaccucgugaccgagaucgggcgcgucccgucccaccuggcccaccggacccgcaacgcgcuggacaaccucgugaugcugcacaccagcgagcacggcgggcgggccuaccgccacgccguggaggagcugcccgagacgauggagacccuccugcugcucggccugaugauccugcucaccgggggcgccaugcuguuccugaucagcggcaaggggaucggcaagaccuccaucgggcucaucugcgucaucgccagcuccggcaugcuguggauggcggagaucccccugccguggaucgccagcgccaucgugcucgaguucuucaugauggugcugcugauccccgagcccgagaagcagcggacgccccaggacaaccagcucgccuacgucgugaucgggauccugacccuggccgcgaucaucgccgccaacgagaugggccuccuggagaccaccaagcgcgaccugggcauguccaaggagccggggguggucagccccacguccuaccucgacguggaccugcaccccgccagcgcguggacccuguacgccguggccaccaccgucaucacgcccaugcuccggcacaccaucgagaacuccaccgccaacgugagccuggccgcgaucgccaaccaggccgugguccugaugggccucgacaagggguggccgaucuccaagauggaccugggcgugccccugcucgcccuggggugcuacagccaggugaacccccugacccucacggccgcgguccugcugcucaucacccacuacgccaucaucggccccggccugcaggccaaggccacccgcgaggcccagaagcggaccgcggccgggaucaugaagaacccgacgguggacggcaucaugaccaucgaccuggaccccgugaucuacgacuccaaguucgagaagcagcucgggcaggucaugcugcuggugcucugcgccgugcagcugcugcucaugcgcaccagcugggcccugugcgaggcgcugacccucgccacgggccccaucaccacccugugggagggcucccccgggaaguucuggaacaccacgaucgccgucagcauggccaacaucuuccggggcuccuaccuggccggggcgggccucgccuucagcaucaugaaguccguggggaccggcaagcgcggcaccgggagccagggcgagacccugggggagaaguggaagaagaagcugaaccagcucagccggaaggaguucgaccuguacaagaaguccggcaucaccgagguggaccgcacggaggccaaggaggggcugaagcggggcgagaucacccaccacgccgucagccgcggcuccgccaagcuccagugguucguggagcggaacauggugaucccggaggggcgcgucaucgaccugggcugcgggcggggcggguggagcuacuacugcgcgggccugaagaaggugaccgaggugcgcggcuacaccaagggcgggcccgggcacgaggagcccguccccauguccacguacggcuggaacaucgugaagcucaugagcgggaaggacguguucuaccugccgcccgagaagugcgacacccugcugugcgacaucggcgaguccagccccucccccaccgucgaggagagccgcaccauccgggugcucaagaugguggagccguggcugaagaacaaccaguucugcaucaagguccugaaccccuacaugcccacggugaucgagcaccucgagcgccugcagcggaagcacggcgggaugcuggugcgcaacccccucucccggaacagcacccacgagauguacuggaucuccaacggcaccgggaacaucgucgccagcgugaacauggugucccgccugcugcucaaccgguucaccaugacgcaccgccggccgaccaucgagaaggacgucgaccugggcgccggcacccgccacgugaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggcgaccgggagcgccuccagcaugaucaacggcguggucaagcugcucaccaagcccugggacguggugcccauggucacgcagauggccaugaccgacaccacccccuucgggcagcagcggguguucaaggagaagguggacacgcgcaccccgcggagcaugcccggcacccgccgggucaugggcaucaccgccgaguggcuguggcgcacgcuggggcggaacaagaagccccgccucugcacccgcgaggaguucaccaagaaggugcggaccaacgcggccaugggcgccguguucacggaggagaaccagugggacuccgccaaggccgcggucgaggacgaggacuucuggaagcugguggaccgcgagcgggagcugcacaagcucgggaagugcggcagcugcguguacaacaugauggggaagcgcgagaagaagcugggcgaguucggcaaggccaaggggucccgggccaucugguacauguggcugggcgcccgcuaccucgaguucgaggcccugggguuccugaacgaggaccacugguucagccgggagaacuccuacagcggcgucgagggggagggccuccacaagcugggcuacauccugcgcgacaucuccaagauccccgggggcgcgauguacgccgacgacaccgccgggugggacacccggaucaccgaggacgaccuccacaacgaggagaagaucacgcagcagauggacccggagcaccgccagcuggccaacgccaucuucaagcugaccuaccagaacaagguggugaagguccagcggcccacccccaccggcaccgugauggacaucaucagccgcaaggaccagcggggcuccggccaggugggcacguacgggcucaacaccuucaccaacauggaggcgcagcugauccgccagauggagggcgaggggguccugagcaaggccgaccucgagaacccccaccucccggagaagaagaucacccaguggcuggagacgaagggcguggagcggcucaagcgcauggccaucuccggcgacgacugcguggucaagcccaucgacgaccgguucgccaacgcccugcuggcgcucaacgacauggggaaggugcgcaaggacaucccccaguggcagcccagcaagggcuggcacgacuggcagcaggucccguucugcucccaccacuuccacgagcugaucaugaaggacgggcggaagcuggucgugcccugccgcccccaggacgagcucaucggccgggcccgcaucagccagggggccggcuggucccugcgcgagaccgccugccugggcaaggcguacgcccagauguggagccucauguacuuccaccggcgcgaccugcggcuggccuccaacgccaucugcagcgccgugcccguccacugggugccgaccucccgcaccacguggagcauccacgcgcaccaccaguggaugaccaccgaggacaugcucaccguguggaaccgggucuggaucgaggacaaccccuggauggaggacaagacgcccgugaccaccugggagaacgugcccuaccuggggaagcgcgaggaccaguggugcggcagccugaucgggcucaccucccgggccacgugggcccagaacaucccgaccgccauccagcagguccgcagccugaucggcaacgaggaguuccuggacuacaugcccuccaugaagcgguuccgcaaggaggaggagagcgagggggccaucugguga

SEQ ID NO: 9867 - RNA, 9873 nt, Artificial Sequence
  derived and/or modified CDS sequence (opt1) from DENV-3__JF808125__SS-prME
accagccucugccucaugaugauccugcccgcggcccuggcguuccaccucaccagccgcgacggcgagccccggaugaucgugggggagaacgagcggggcaagagccugcuguucaagaccgccagcgggaucaaccggcgcacccucaucgccauggaccugggcgagaugugcgaggagaccgagaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgucggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaaggucgugaucuucauccugcugaugcucgugacgcccagcaugaccaugcgcugcgucggggugggcaaccgggacuucguggagggccuguccggggccaccugggucgacguggugcuggagcacggcgggugcgucaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggccagcaccaccgaggcgauccugcccgaguacggcacccuggggcucgagugcuccccgcggaccggccuggacuucaacgagaugauccugcucacgaugaagaacaaggccuggaugguccaccgccagugguucuucgaccugccccugcccuggaccagcggcgccaccgccgagacccccacguggaaccggaaggagcuccuggugaccuucaagaacgcccacgcgaagaagcaggagguggucgugcuggggucccaggagggcgccaugcacaccgcccucaccggggccacggagauccagaacagcggcgggaccuccaucuucgccggccaccugaagugccgccugaagauggacaagcucgagcugaagggcaugagcuacgcgaugugcaccaacaccuucgugcugaagaaggaggucuccgagacgcagcacgggaccauccucaucaagguggaguacaagggcgaggacgccccgugcaagauccccuucagcaccgaggacgggcagggcaaggcccacaacggccggcugaucaccgccaaccccguggucacgaagaaggaggagcccgugaacaucgaggcggagccgcccuucggggagagcaacaucgugaucggcaucggggacaacgcccugaagaucaacugguacaagaagggcuccagcaucgggaagauguucgaggccaccgcccgcggcgcccgccggauggcgauccugggcgacaccgccugggacuucggguccgucggcggggugcucaacagccugggcaagauggugcaccagaucuucggguccgccuacaccgcccuguucagcggcgucuccugggugaugaagaucggcaucggggugcuccugacguggaucggccugaacagcaagaacaccuccaugagcuucuccugcaucgccaucgggaucaucacccucuaccugggcgcggucgugcaggccgacauggggugcgugaucaacuggaagggcaaggagcugaagugcggcagcgggaucuucgucaccaacgaggugcacacguggaccgagcaguacaaguuccaggccgacucccccaagcgccucgccaccgccaucgcgggcgccugggagaacggggugugcggcauccggagcaccacgcgcauggagaaccugcuguggaagcagaucgccaacgagcucaacuacauccugugggagaacaacaucaagcugaccgucguggugggggacaucaucggcguccucgagcagggcaagcggacccugacgccccagccgauggagcugaaguacuccuggaagacgugggggaaggccaagaucgugaccgcggagacccagaacagcuccuucaucaucgacggccccaacacccccgagugccccagcgccucccgcgccuggaacgugugggaggucgaggacuacggguucggcguguucacgaccaacaucuggcucaagcugcgggagguguacacccagcugugcgaccaccgccucaugagcgccgccgucaaggacgagcgggcggugcacgccgacaugggcuacuggaucgagagccagaagaacggguccuggaagcuggagaaggccagccugaucgaggugaagaccugcaccuggccgaagucccacacgcucuggagcaacggcguccuggaguccgacaugaucauccccaagagccuggccgggcccaucucccagcacaaccaccgcccgggcuaccacacccagaccgccgggcccuggcaccucggcaagcuggagcuggacuucaacuacugcgagggcaccacgguggugaucaccgagaacugcgggacccggggccccagccuccgcaccacgaccgucuccgggaagcugauccacgaguggugcugccggagcugcacccugcccccgcuccgcuacaugggcgaggacgggugcugguacggcauggagauccggcccaucuccgagaaggaggagaacauggucaagagccugguguccgcgggcagcgggaaggucgacaacuucaccaugggcgugcugugccucgccauccuguucgaggaggugaugcgcgggaaguucggcaagaagcacaugaucgccggggucuucuucacguucgugcugcuccuguccggccagaucaccuggcgggacauggcccacacccugaucaugaucggcagcaacgccuccgaccgcauggggaugggcgugaccuaccucgcgcugaucgccacguucaagauccagcccuuccuggcccucggguucuuccugcggaagcugaccagccgcgagaaccuccugcugggcgucggccucgccauggcgaccacccugcagcugcccgaggacaucgagcagauggccaacgggaucgcccucggccugauggcccugaagcucaucacgcaguucgagaccuaccagcuguggaccgcccugaucagccugaccugcuccaacacgauguucacccugaccguggcguggcgcaccgccacgcugauccucgccggggugagccugcugccggucugccaguccagcuccaugcggaagaccgacuggcuccccauggccguggccgcgaugggcgugccgccccucccgcuguucaucuucagccucaaggacacccugaagcgccgguccuggccccugaacgagggggugauggccgugggccucgucagcauccuggccuccagccugcuccgcaacgacgugcccauggccggcccccugguggccgggggccugcucaucgcgugcuacgucaucaccgggacguccgccgaccugaccguggagaaggccgccgacaucaccugggaggaggaggccgagcagaccggcgugagccacaaccugaugaucacggucgacgacgacgggaccaugcggaucaaggacgacgagaccgagaacauccucaccgugcugcugaagaccgcgcuccugaucguguccggcgucuucccguacagcauccccgccacgcugcucguguggcacaccuggcagaagcagacccagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacccgcggcgccgugcucaccuacaacgggaagcggcuggagcccaacugggcguccgugaagaaggaccugaucagcuccggcgggggcuggcgccucagcgcccaguggcagaagggggaggagguccaggugaucgccguggagcccggcaagaaccccaagaacuuccagacgaugcccggcaccuuccagaccaccacgggggagaucggcgccaucgcccuggacuucaagcccgggaccagcggcucccccaucaucaaccgggagggcaaggucguggggcuguacggcaacgggguggucaccaagaacggcggguacgugagcggcaucgcgcagaccaacgccgagccggacggccccacgcccgagcuggaggaggagauguucaagaagcgcaaccucaccaucauggaccugcaccccggguccggcaagacccggaaguaccugccggccaucgugcgcgaggccaucaagcggcgccuccggacccugauccuggcccccacgcgcgucguggcggccgagauggaggaggcccucaaggggcugcccauccgguaccagaccaccgccaccaagagcgagcacacgggccgcgagaucguggaccugaugugccacgccaccuucaccaugcggcuccugucccccguccgcgugccgaacuacaaccugaucaucauggacgaggcgcacuucaccgaccccgccagcaucgccgcccgcggguacaucuccacgcgggugggcaugggcgaggcggccgccaucuucaugaccgccacgccgcccgggaccgccgacgcguucccgcagagcaacgcccccauccaggacgaggagcgcgacauccccgagcgguccuggaacagcggcaacgaguggaucacggacuucgccgggaagaccgucugguucgugcccuccaucaaggccggcaacgacaucgccaacugccuccgcaagaacgggaagaaggugauccagcugagccggaagaccuucgacaccgaguaccagaagacgaagcugaacgacugggacuucgucgugaccaccgacaucuccgagaugggcgcgaacuucaaggccgaccgcgugaucgacccgcggcgcugccucaagcccgucauccugaccgacggccccgagcgggugauccuggccgggcccaugccggugacggccgccagcgcggcccagcgccggggccgcgucgggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgccgccaucgacggcgaguaccggcugaagggcgagagccgcaagaccuucguggagcugaugcggcgcggggaccuccccguguggcuggcccacaaggucgccuccgagggcaucaaguacacggaccggaaguggugcuucgacgggcagcgcaacaaccagauccuggaggagaacauggacguggagaucuggaccaaggagggcgagaagaagaagcuccgcccccgguggcuggacgcgcgcaccuacagcgacccgcuggcccucaaggaguucaaggacuucgccgccggccggaaguccaucgcccuggaccuggucaccgagaucgggcgcgugcccagccaccucgcgcaccggacgcgcaacgcccuggacaaccuggugaugcuccacaccagcgagcacggcgggcgggccuaccgccacgccgucgaggagcugcccgagaccauggagacccugcuccugcugcggcucaugauccugcugacgggcggggccaugcuguuccugaucuccggcaagggcaucgggaagaccagcaucggccugaucugcgugaucgcguccagcgggaugcucuggauggccgagaucccgcugcaguggaucgccuccgccaucgugcuggaguucuucaugaugguccuccugauccccgagcccgagaagcagcgcacgccccaggacaaccagcuggccuacguggugaucggcauccucacccuggcggccaucaucgccgccaacgagauggggcugcucgagacgaccaagcgggaccugggcaugagcaaggagccgggcgucgugucccccaccagcuaccuggacguggaccuccaccccgcguccgccuggacccuguacgccgucgccacgaccgugaucacccccaugcugcgccacaccaucgagaacagcacggccaacgugucccucgcggccaucgccaaccaggccgucgugcugauggggcuggacaagggcuggccgaucagcaagauggaccucggggugccccugcuggcccucggcugcuacucccaggucaacccccugacccugaccgcggccgugcuccugcugaucacccacuacgccaucaucgggcccggccuccaggccaaggccacgcgggaggcgcagaagcgcaccgccgccggcaucaugaagaacccgaccguggacgggaucaugaccaucgaccuggaccccgucaucuacgacagcaaguucgagaagcagcugggccaggugaugcuccuggugcugugcgccguccagcuccugcugaugcggacguccugggcgcucugcgaggcccugacccuggccaccgggcccaucaccacgcucugggagggcagccccggcaaguucuggaacaccaccaucgccguguccauggccaacaucuuccgcgggagcuaccuggcgggcgccgggcuggccuucuccaucaugaaguccgugggcaccgggaagcggggcacgggcagccagggggagacccucggcgagaaguggaagaagaagcugaaccagcugucccgcaaggaguucgaccucuacaagaaguccgggaucaccgaggucgaccggaccgaggccaaggagggccugaagcgcggggagaucacccaccacgccgugucccggggcagcgcgaagcugcagugguucguggagcgcaacauggucaucccggagggccgcgugaucgaccucgggugcggccgcgggggcugguccuacuacugcgccgggcugaagaaggugacggagguccgcggcuacaccaagggcgggcccggccacgaggagcccgugcccaugagcaccuacggguggaacaucgugaagcugauguccggcaaggacgucuucuaccucccgcccgagaagugcgacacccugcugugcgacaucggggagagcucccccagccccacgguggaggagucccggaccauccgcgugcugaagauggucgagccguggcucaagaacaaccaguucugcaucaaggugcugaaccccuacaugcccaccgugaucgagcaccuggagcggcuccagcgcaagcacggcggcaugcugguccggaacccccugagccgcaacuccacccacgagauguacuggaucagcaacgggacgggcaacaucguggccuccgugaacauggucagccggcuccugcugaaccgcuucaccaugacccaccggcgcccgaccaucgagaaggacguggaccucggggccggcacgcggcacgugaacgccgagcccgagacccccaacauggacgucaucggcgagcgcaucaagcggaucaaggaggagcacaacuccaccuggcacuacgacgacgagaacccguacaagaccugggcguaccacgggagcuacgaggugaaggccacgggcuccgccagcagcaugaucaacgggguggucaagcugcugaccaagcccugggacgugguccccauggugacccagauggccaugaccgacacgacccccuucggccagcagcgcguguucaaggagaaggucgacacccggaccccgcgcuccaugcccgggacgcggcgcgugaugggcaucaccgcggaguggcucuggcgcacccugggccggaacaagaagccccgccugugcacccgggaggaguucacgaagaaggugcgcaccaacgccgccaugggggccgucuucaccgaggagaaccagugggacagcgccaaggcggccguggaggacgaggacuucuggaagcucguggaccgggagcgcgagcugcacaagcugggcaagugcggguccugcgucuacaacaugaugggcaagcgggagaagaagcucggggaguucggcaaggccaagggcagccgcgccaucugguacauguggcugggggcccgguaccuggaguucgaggcgcucggcuuccugaacgaggaccacugguucucccgcgagaacagcuacuccgggguggagggcgaggggcugcacaagcucggcuacauccugcgggacaucagcaagauccccggcggggccauguacgccgacgacaccgccggcugggacacgcgcaucaccgaggacgaccugcacaacgaggagaagaucacccagcagauggacccggagcaccggcagcucgccaacgcgaucuucaagcugaccuaccagaacaagguggucaaggugcagcgccccacgcccaccgggaccgugauggacaucaucucccggaaggaccagcgcggcagcggccaggucgggaccuacggccugaacaccuucacgaacauggaggcccagcucauccggcagauggagggggagggcgugcuguccaaggccgaccuggagaacccccaccucccggagaagaagaucacccaguggcuggagaccaaggggguggagcgccugaagcggauggccaucagcggcgacgacugcgucgugaagcccaucgacgaccgcuucgccaacgcgcuccuggcccugaacgacaugggcaaggugcggaaggacaucccccaguggcagcccuccaagggguggcacgacuggcagcaggucccguucugcagccaccacuuccacgagcucaucaugaaggacggccgcaagcugguggugcccugccgcccccaggacgagcugaucgggcgggcccgcaucucccagggcgccggguggagccuccgggagaccgcgugccugggcaaggccuacgcccagauguggucccugauguacuuccaccgccgggaccuccgccuggccagcaacgccaucugcuccgcgguccccgugcacugggugccgacgagccggaccaccuggagcauccacgcccaccaccaguggaugaccacggaggacaugcugaccgucuggaaccgcguguggaucgaggacaaccccuggauggaggacaagacccccgugaccacgugggagaacguccccuaccucggcaagcgggaggaccaguggugcgggucccugaucggccugaccagccgcgccaccugggcccagaacaucccgaccgccauccagcagguccggucccucaucgggaacgaggaguuccuggacuacaugcccagcaugaagcgcuuccggaaggaggaggaguccgagggcgcgaucugguga

SEQ ID NO: 9868 - RNA, 9873 nt, Artificial Sequence
  derived and/or modified CDS sequence (opt1) from DENV-3__JF808129__SS-prME
accagccugugccucaugaugauccugcccgccgcccuggcguuccaccucaccagccgggacggggagccgcggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgugacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaccggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccggccgggcuaccacacccagacggccgggcccuggcaccucggcaagcuggagcuggacuucaacuacugcgagggcaccaccguggucaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccuggucuccgccggcagcgggaagguggacaacugcaccaugggcgugcugugccucgcgauccuguucgaggacgucaugcgggggaaguucggcaagaagcacaugaucgccgggguguucuucaccuucgugcugcuccuguccggccagaucaccuggcgcgacauggcccacacgcugaucaugaucggcagcaacgccuccgaccggauggggaugggcgucaccuaccucgcccugaucgcgaccuucaagauccagcccuuccuggcccucggguucuuccugcgcaagcugaccagccgggagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccauguucacccugacgguggccuggcgcaccgcgacccugauccucgccggggucagccugcugccggugugccaguccagcuccaugcggaagaccgacuggcuccccauggccgucgccgccaugggcgugccgccccucccgcuguucaucuucagccucaaggacacgcugaagcgccgcuccuggccccugaacgagggggugauggcggucggccucgugagcauccuggccuccagccugcuccggaacgacgugcccauggccggcccccuggucgccgggggccugcucaucgccugcuacgugaucaccgggaccuccgcggaccugaccguggagaaggccgccgacaucacgugggaggaggaggccgagcagaccggcgucagccacaaccugaugaccaccguggacgacgacgggaccaugcgcaucaaggacgacgagacggagaacauccucaccgugcugcugaagaccgcccucaccaucgucuccggcguguucccguacagcauccccgcgacgcugcugguguggcacaccuggcagaagcagacccagcgguccggcguccucugggacgugcccagcccgcccgagacccagaaggccgagcaggaggaggggguguaccgcaucaagcagcagggcaucuucgggaagacgcaggucggcgugggggugcagaaggagggcgucuuccacaccauguggcacgugacccggggcgccgugcugaccuacaacgggaagcgccuggagcccaacugggccuccgucaagaaggaccucaucagcuacggcgggggcuggcggcuguccgcgcaguggcagaagggggaggagguccaggugaucgccgucgagcccggcaagaaccccaagaacuuccagacgaugcccggcaccuuccagaccaccacgggggagaucggcgccaucgcccuggacuucaagcccgggaccagcggcagccccaucaucaaccgcgagggcaaggugguggggcucuacggcaacggggucgugaccaagaacggcggguacguguccggcaucgcccagaccaacgcggagccggacggccccacgcccgagcuggaggaggagauguucaagaagcggaaccugaccaucauggaccugcaccccgggagcggcaagacccgcaaguaccucccggccaucguccgggaggccaucaagcgccggcugcgcacccugauccucgcccccacgcgggugguggccgcggagauggaggaggcccugaaggggcugcccauccgcuaccagaccaccgccaccaaguccgagcacacgggccgggagaucgucgaccucaugugccacgccaccuucaccaugcgccugcugagccccgugcgggugccgaccuacaaccucaucaucauggacgaggcccacuucacggaccccgcguccaucgccgcccgcggguacaucagcacccgggucggcaugggcgaggccgcggccaucuucaugaccgccacgccgcccgggacggccgacgccuucccgcaguccaacgcgcccauccaggacgaggagcgcgacauccccgagcgcagcuggaacuccggcaacgaguggaucaccgacuucgccgggaagaccgugugguucgugcccagcaucaaggccggcaacgacaucgccaacugccugcggaagaacgggaagaaggucauccagcugucccgcaagaccuucgacacggaguaccagaagaccaagcucaacgacugggacuucguggugaccaccgacaucagcgagaugggcgccaacuucaaggcggaccgggucaucgacccgcgccggugccugaagcccgugauccugaccgacggccccgagcgcgugauccucgccgggcccaugccggucacggccgccuccgccgcgcagcggcgcggccggguggggcgcaacccccagaaggagaacgaccaguacaucuucaccggccagccccugaacaacgacgaggaccacgcccacuggaccgaggccaagaugcugcucgacaacaucaacacccccgaggggaucaucccggcccuguucgagcccgagcgggagaaguccgcggccaucgacggcgaguaccgccugaagggcgagucccggaagacguucguggagcucaugcgccgcggggaccugcccgucuggcuggcccacaagguggccagcgagggcaucaaguacaccgaccgcaaguggugcuucgacgggcagcggaacaaccagauccucgaggagaacauggacgucgagaucuggaccaaggagggcgagaagaagaagcugcgcccccgguggcuggacgcccgcaccuacuccgacccgcucgcgcugaaggaguucaaggacuucgccgccggccgcaagagcaucgcccuggaccucgugacggagaucgggcgggugcccucccaccuggcccaccgcacccggaacgcgcuggacaaccucgucaugcugcacaccagcgagcacggcgggcgcgccuaccggcacgccguggaggagcugcccgagaccauggagacgcuccugcugcucggccugaugauccugcucaccgggggcgccaugcuguuccugaucagcggcaaggggaucggcaagaccuccaucgggcucaucugcgugaucgccagcuccggcaugcuguggauggcggagaucccgcugcaguggaucgccagcgccaucguccucgaguucuucaugauggugcugcugauccccgagcccgagaagcagcgcacgccccaggacaaccagcucgccuacguggucaucgggauccugacgcuggccgcgaucaucgccgccaacgagaugggccuccuggagaccaccaagcgggaccugggcauguccaaggagccggggguggugagccccaccuccuaccucgacgucgaccugcaccccgccagcgcguggacgcuguacgccguggccaccaccgugaucacccccaugcuccgccacacgaucgagaacuccaccgccaacgucagccuggccgcgaucgccaaccaggccguggugcugaugggccucgacaagggguggccgaucuccaagauggaccugggcgucccccugcucgcccuggggugcuacagccaggugaacccccugacccucaccgccgcggugcugcugcucaucacgcacuacgccaucaucggccccggccugcaggccaaggccacccgggaggcccagaagcgcaccgcggccgggaucaugaagaacccgaccgucgacggcaucaugacgaucgaccuggaccccgugaucuacgacuccaaguucgagaagcagcucggccaggugaugcugcugguccucugcgccgugcagcugcugcucaugcggaccagcugggcccugugcgaggcgcugacccucgccaccggccccaucacgacccugugggagggcucccccgggaaguucuggaacaccaccaucgccgugagcauggccaacaucuuccgcggcuccuaccuggccggggcgggccucgccuucagcaucaugaaguccgucgggaccggcaagcggggcacggggagccagggcgagacccugggggagaaguggaagaagaagcugaaccagcucagccgcaaggaguucgaccuguacaagaaguccggcaucaccgagguggaccggaccgaggccaaggaggggcugaagcgcggcgagaucacgcaccacgccgugagccggggcuccgccaagcuccagugguucgucgagcgcaacauggugaucccggaggggcgggugaucgaccugggcugcgggcgcggcggguggagcuacuacugcgcgggccugaagaaggucaccgaggugcggggcuacaccaagggcgggcccgggcacgaggagcccgugcccauguccaccuacggcuggaacaucgucaagcucaugagcgggaaggacguguucuaccugccgcccgagaagugcgacacgcugcucugcgacaucggcgaguccagccccucccccaccguggaggagagccgcaccauccgcguccugaagaugguggagccguggcugaagaacaaccaguucugcaucaaggugcugaaccccuacaugcccaccgucaucgagcaccucgagcggcugcagcgcaagcacggcgggaugcuggugcggaacccccucucccgcaacagcacgcacgagauguacuggaucuccaacggcaccgggaacaucguggccagcgucaacauggugucccggcugcugcucaaccgcuucaccaugacccaccggcgcccgacgaucgagaaggacguggaccugggcgccggcacccggcacgucaacgccgagcccgagacccccaacauggacgugaucggggagcgcaucaagcggaccaaggaggagcacaacagcacguggcacuacgacgacgagaacccguacaagaccugggccuaccacggcuccuacgaggugaaggcgaccgggagcgccuccagcaugaucaacggcgucgugaagcugcucaccaagcccugggacgucgugcccauggugacgcagauggccaugaccgacaccacccccuucgggcagcagcgcgucuucaaggagaagguggacacgcggaccccgcgcagcaugcccggcacccggcgcgugaugggcaucaccgccgaguggcuguggcggacgcuggggcgcaacaagaagccccggcucugcacccgcgaggaguucaccaagaagguccgcaccaacgcggccaugggcgccguguucacggaggagaaccagugggacuccgccaaggccgcgguggaggacgaggacuucuggaagcuggucgaccgggagcgcgagcugcacaagcucgggaagugcggcagcugcguguacaacaugauggggaagcgggagaagaagcugggcgaguucggcaaggccaaggggucccgcgccaucugguacauguggcugggcgcccgguaccucgaguucgaggcccugggguuccugaacgaggaccacugguucagccgcgagaacuccuacagcggcguggagggggagggccuccacaagcugggcuacauccugcgggacaucuccaagauccccgggggcgcgauguacgccgacgacaccgccgggugggacacccgcaucaccgaggacgaccuccacaacgaggagaagaucacccagcagauggacccggagcaccggcagcuggccaacgccaucuucaagcugacguaccagaacaaggucgugaaggugcagcgccccacccccaccggcaccgucauggacaucaucagccggaaggaccagcgcggcuccggccaggugggcacguacgggcucaacaccuucaccaacauggaggcgcagcugauccggcagauggagggcgagggggugcugagcaaggccgaccucgagaacccccaccuccccgagaagaagaucacccaguggcuggagacgaagggcgucgagcgccugaagcggauggccaucuccggcgacgacugcguggugaagcccaucgacgaccgcuucgccaacgcccugcuggcgcucaacgacauggggaagguccggaaggacaucccccaguggcagcccagcaagggcuggcacgacuggcagcaggucccguucugcucccaccacuuccacgagcugaucaugaaggacgggcgcaagcuggugguccccugccggccccaggacgagcucaucggccgcgcccggaucagccagggggccggcuggucccugcgcgagaccgccugccugggcaaggcguacgcccagauguggagccucauguacuuccaccgccgggaccugcgccuggccuccaacgccaucugcagcgccgugcccgugcacugggucccgaccucccggaccacguggagcauccacgcgcaccaccaguggaugaccaccgaggacaugcucaccguguggaaccgcguguggaucgaggacaaccccuggauggaggacaagacgcccgucaccaccugggagaacgugcccuaccuggggaagcgggaggaccaguggugcggcagccugaucgggcucaccucccgcgccacgugggcccagaacaucccgaccgccauccagcagguccggagccugaucggcaacgaggaguuccuggacuacaugcccuccaugaagcgcuuccggaaggaggaggagagcgagggggccaucugguga

SEQ ID NO: 9869 - RNA, 9873 nt, Artificial Sequence
  derived and/or modified CDS sequence (opt1) from DENV-3__JF808123__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggugaucuucauccugcugaugcucgugacgcccagcaugaccaugcgcugcgugggggugggcaaccgggacuucguggagggccuguccggggccaccuggguggacgugguccuggagcacggcgggugcgugaccacgauggccaagaacaagcccacccucgacaucgagcugcagaagaccgaggccacccaccuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccugggccccaucgaggggaaggucgugcaguacgagaaccucaaguacaccgugaucaucacgguccacaccggcgaccagcaccagguggggaacgagacccagggcgucaccgccgagaucacgccccaggccagcaccaccgaggcgauccugcccgaguacgggacccugggccucgagugcuccccgcggaccggccuggacuucaacgagaugauccugcucacgaugaagaacaaggccuggauggugcaccgccagugguucuucgaccugccccugcccuggaccagcggggccaccaccgagacgcccaccuggaaccggaaggagcuccuggugaccuucaagaacgcccacgccaagaagcaggaggucguggugcugggcucccaggagggggcgaugcacaccgcccucacgggcgccaccgagauccagaacagcgggggcaccuccaucuucgccggccaccugaagugccgccugaagauggacaagcucgagcugaaggggaugagcuacgccaugugcaccaacacguucguccugaagaaggagguguccgagacccagcacggcaccauccucaucaagguggaguacaagggggaggacgcgccgugcaagauccccuucagcaccgaggacggccagggcaaggcccacaacgggcggcugaucacggccaaccccgucgugaccaagaaggaggagcccgugaacaucgaggccgagccgcccuucggcgagagcaacaucgucaucgggaccggcgacaacgcgcugaagaucaacugguacaagaagggguccagcaucggcaagauguucgaggccaccgcccgcggcgcccggcgcauggccauccugggggacacggcgugggacuucggcuccgucgggggcgugcucaacagccuggggaagaugguccaccagaucuucggcuccgccuacaccgcccuguucagcggcguguccugggugaugaagaucgggaucggcguccuccugaccuggaucgggcugaacagcaagaacaccuccaugagcuucuccugcaucgccaucggcaucaucacgcucuaccugggggccguggugcaggcggacaugggcugcgucaucaacuggaagggcaaggagcugaagugcgggagcggcaucuucgugaccaacgaggugcacaccuggaccgagcaguacaaguuccaggccgacucccccaagcgccucgccacggccaucgccggggcgugggagaacggcgucugcgggauccggagcaccacccgcauggagaaccugcuguggaagcagaucgccaacgagcucaacuacauccugugggagaacaacaucaagcugaccgugguggucggcgacaucaucggcgugcucgagcaggggaagcggacgcugacgccccagccgauggagcugaaguacuccuggaagaccuggggcaaggccaagaucgugaccgccgagacgcagaacagcuccuucaucaucgacgggcccaacacccccgagugccccagcgcgucccgcgccuggaacgucugggagguggaggacuacggcuucggcguguucaccaccaacaucuggcucaagcugcgggaggucuacacccagcugugcgaccaccgccucaugagcgccgccgugaaggacgagcgggccgugcacgcggacaugggguacuggaucgagagccagaagaacggcuccuggaagcuggagaaggccagccugaucgaggucaagacgugcaccuggccgaagucccacacccucuggagcaacggggugcuggaguccgacaugaucauccccaagagccuggccggccccaucucccagcacaaccaccgcccgggguaccacacccagacggccggccccuggcaccucggcaagcuggagcuggacuucaacuacugcgaggggaccaccguggucaucaccgagaacugcggcacgcgggggcccagccuccgcaccaccaccguguccggcaagcugauccacgaguggugcugccggagcugcacgcugcccccgcuccgcuacaugggggaggacggcugcugguacggcauggagauccggcccaucuccgagaaggaggagaacauggucaagagccuggucuccgccgggagcggcaagguggacaacuucaccaugggggugcugugccucgcgauccuguucgaggaggucaugcgcggcaaguucgggaagaagcacaugaucgccggcguguucuucaccuucgugcugcuccuguccggccagaucaccuggcgggacauggcccacacgcugaucaugaucgggagcaacgccuccgaccgcaugggcaugggggucaccuaccucgcccugaucgcgaccuucaagauccagcccuuccuggcccucggcuucuuccugcggaagcugaccagccgcgagaaccuccugcugggcguggggcucgccauggccacgacccugcagcugcccgaggacaucgagcagauggcgaacggcaucgcccucgggcugauggcccugaagcucaucacccaguucgagaccuaccagcuguggacggcccugaucagccugaccugcuccaacaccauguucacccugacgguggccuggcggaccgcgacccugauccucgccggcgucagccugcugccggugugccaguccagcuccaugcgcaagaccgacuggcuccccauggccgucgccgccaugggggugccgccccucccgcuguucaucuucagccucaaggacacgcugaagcgccgguccuggccccugaacgagggcgugauggcggucggccucgugagcauccuggccuccagccugcuccgcaacgacgugcccauggccgggccccuggucgccggcgggcugcucaucgccugcuacgugaucaccggcaccuccgcggaccugaccguggagaaggccgccgacaucacgugggaggaggaggccgagcagaccggggucagccacaaccugaugaucaccguggacgacgacggcaccaugcggaucaaggacgacgagaccgagaacauccucacggugcugcugaagaccgcccuccugaucgucuccggcguguucccguacagcauccccgcgacccugcucguguggcacaccuggcagaagcagacgcagcgcuccgggguccugugggacgugcccagcccgcccgagacccagaaggccgagcuggaggagggcguguaccggaucaagcagcaggggaucuucggcaagacccaggucggggugggcgugcagaaggagggcgucuuccacaccauguggcacgugacgcgcggggccgugcucaccuacaacggcaagcggcuggagcccaacugggccuccgucaagaaggaccugaucagcuacgggggcggguggcgccucuccgcgcaguggcagaagggcgaggagguccaggugaucgccgucgagcccggcaagaaccccaagaacuuccagaccaugcccgggaccuuccagacgaccaccggcgagaucggggccaucgcccuggacuucaagcccggcaccagcggcagccccaucaucaaccgggaggggaagguggugggccuguacgggaacggcgucgugacgaagaacgggggcuacguguccggcaucgcccagaccaacgcggagccggacgggcccacccccgagcuggaggaggagauguucaagaagcgcaaccucaccaucauggaccugcaccccggcagcgggaagacgcggaaguaccugccggccaucguccgcgaggccaucaagcggcgccuccggacccugauccuggcccccacccgcgugguggccgcggagauggaggaggcccucaagggccugcccauccgguaccagaccacggccaccaaguccgagcacaccgggcgcgagaucgucgaccugaugugccacgccaccuucacgaugcggcuccugagccccgugcgcgugccgaacuacaaccugaucaucauggacgaggcccacuucaccgaccccgcguccaucgccgcccggggcuacaucagcacccgcgucggcaugggggaggccgcggccaucuucaugaccgccacgccgcccggcaccgccgacgccuucccgcaguccaacgcgcccauccaggacgaggagcgcgacauccccgagcggagcuggaacuccgggaacgaguggaucaccgacuucgccggcaagaccgugugguucgugcccagcaucaaggccgggaacgacaucgccaacugccuccgcaagaacggcaagaaggucauccagcugucccggaagacguucgacaccgaguaccagaagaccaagcugaacgacugggacuucguggugaccacggacaucagcgagaugggcgccaacuucaaggcggaccgcgucaucgacccgcggcgcugccucaagcccgugauccugaccgacgggcccgagcgggugauccuggccggccccaugccggucaccgccgccuccgccgcgcagcgccgggggcgcgugggccggaacccccagaaggagaacgaccaguacaucuucaccgggcagccccucaacaacgacgaggaccacgcccacuggaccgaggccaagaugcugcuggacaacaucaacacgcccgagggcaucaucccggcccucuucgagcccgagcgcgagaaguccgcggccaucgacggcgaguaccggcugaagggggagucccgcaagaccuucguggagcugaugcggcgcggcgaccuccccgucuggcuggcccacaagguggccagcgaggggaucaaguacaccgaccggaaguggugcuucgacggccagcgcaacaaccagauccuggaggagaacauggacgucgagaucuggaccaaggagggcgagaagaagaagcuccggccccgcuggcuggacgcccgcacguacuccgacccgcuggcgcucaaggaguucaaggacuucgccgccgggcgcaagagcaucgcccuggaccuggugaccgagaucggccgcgugcccucccaccucgcccaccggacccgcaacgcgcuggacaaccuggucaugcuccacaccagcgagcacgggggccgggccuaccgccacgccguggaggagcugcccgagacgauggagacccugcuccugcuggggcucaugauccugcugaccggcggcgccaugcuguuccugaucagcgggaagggcaucgggaagaccuccaucggccugaucugcgugaucgccagcuccgggaugcucuggauggcggagaucccgcugcaguggaucgccagcgccaucguccuggaguucuucaugauggugcuccugauccccgagcccgagaagcagcggacgccccaggacaaccagcuggccuacguggucaucggcauccucacccuggccgcgaucaucgccgccaacgagaugggccugcucgagaccaccaagcgcgaccuggggauguccaaggagccgggcguggugagccccacguccuaccuggacgucgaccuccaccccgccagcgcguggacccuguacgccguggccaccaccgugaucacgcccaugcugcggcacaccaucgagaacuccaccgccaacgucagccucgccgcgaucgccaaccaggccguggugcugauggggcuggacaagggcuggccgaucuccaagauggaccucggggucccccugcuggcccucggcugcuacagccaggugaacccccugacccugacggccgcggugcuccugcugaucacccacuacgccaucaucggccccgggcuccaggccaaggccacccgcgaggcccagaagcggaccgcggccggcaucaugaagaacccgacggucgacgggaucaugaccaucgaccuggaccccgugaucuacgacuccaaguucgagaagcagcugggccaggugaugcuccugguccugugcgccgugcagcuccugcugaugcgcaccagcugggcccucugcgaggcgcugacccuggccacgggccccaucaccacccucugggaggggucccccggcaaguucuggaacaccacgaucgccgugagcauggccaacaucuuccggggguccuaccuggccggcgcggggcuggccuucagcaucaugaaguccgucggcaccggcaagcgcgggaccggcagccagggggagacccucggcgagaaguggaagaagaagcugaaccagcugagccggaaggaguucgaccucuacaagaaguccgggaucaccgagguggaccgcacggaggccaaggagggccugaagcggggcgagaucacccaccacgccgugagccgcggguccgccaagcugcagugguucgucgagcggaacauggugaucccggagggccgcgugaucgaccucgggugcggccgcgggggcuggagcuacuacugcgcgggccugaagaaggucaccgaggugcgcggguacaccaagggcgggcccggccacgaggagcccgugcccauguccacguacggguggaacaucgucaagcugaugagcggcaaggacguguucuaccucccgcccgagaagugcgacacccugcugugcgacaucggcgaguccagccccucccccaccguggaggagagccgcaccauccggguccugaagaugguggagccguggcucaagaacaaccaguucugcaucaaggugcugaaccccuacaugcccacggucaucgagcaccuggagcgccuccagcggaagcacgggggcaugcuggugcgcaacccccugucccggaacagcacccacgagauguacuggaucuccaacgggaccggcaacaucguggccagcgucaacauggugucccgccuccugcugaaccgguucaccaugacgcaccgccggccgaccaucgagaaggacguggaccucggcgccgggacccgccacgucaacgccgagcccgagacccccaacauggacgugaucggcgagcggaucaagcgcaucaaggaggagcacaacagcacguggcacuacgacgacgagaacccguacaagaccugggccuaccacggguccuacgaggugaaggcgaccggcagcgccuccagcaugaucaacggggucgugaagcugcugaccaagcccugggacgucgugcccauggugacgcagauggccaugaccgacaccacccccuucggccagcagcgggucuucaaggagaagguggacacgcgcaccccgcggagcaugcccggcacccgccgggugauggggaucaccgccgaguggcucuggcgcacgcugggccggaacaagaagccccgccugugcacccgcgaggaguucaccaagaagguccggaccaacgcggccaugggggccguguucacggaggagaaccagugggacuccgccaaggccgcgguggaggacgaggacuucuggaagcucgucgaccgcgagcgggagcugcacaagcugggcaagugcgggagcugcguguacaacaugaugggcaagcgcgagaagaagcucggcgaguucgggaaggccaagggcucccgggccaucugguacauguggcugggggcccgcuaccuggaguucgaggcccucggcuuccugaacgaggaccacugguucagccgggagaacuccuacagcgggguggagggcgagggccugcacaagcucggguacauccugcgcgacaucuccaagauccccggcggggcgauguacgccgacgacaccgccggcugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaccggcaccgucauggacaucaucagccgcaaggaccagcggggguccggccagguggggacguacggccugaacaccuucaccaacauggaggcgcagcucauccgccagauggagggggagggcgugcugagcaaggccgaccuggagaacccccaccucccggagaagaagaucacccaguggcuggagacgaagggcgucgagcggcugaagcgcauggccaucuccggggacgacugcguggugaagcccaucgacgaccgguucgccaacgcccuccuggcgcugaacgacaugggcaagguccgcaaggacaucccccaguggcagcccagcaagggguggcacgacuggcagcaggucccguucugcucccaccacuuccacgagcucaucaugaaggacggccggaagcuggugguccccugccgcccccaggacgagcugaucgggcgggcccgcaucagccagggcgccggcuggucccuccgcgagaccgccugccuggggaaggcguacgcccagauguggagccugauguacuuccaccggcgcgaccuccggcuggccuccaacgccaucugcagcgccgugcccgugcacugggucccgaccucccgcaccacguggagcauccacgcgcaccaccaguggaugaccaccgaggacaugcugaccguguggaaccggguguggaucgaggacaaccccuggauggaggacaagacgcccgucaccaccugggagaacgugcccuaccucggcaagcgcgaggaccaguggugcgggagccugaucggccugaccucccgggccacgugggcccagaacaucccgaccgccauccagcagguccgcagccucaucgggaacgaggaguuccuggacuacaugcccuccaugaagcgguuccgcaaggaggaggagagcgagggcgccaucugguga

SEQ ID NO: 9870 - RNA, 9873 nt, Artificial Sequence
  derived and/or modified CDS sequence (opt1) from DENV-3__JF808128__SS-prME
accagccugugccucaugaugauccugcccgccgcccuggcguuccaccucaccagccgggacggggagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccagccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagcggaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguuccuggaccugccccuccccuggaccagcggcgccaccaccgagacgcccaccuggaaccggaaggagcugcuggugaccuucaagaacgcccacgccaagaagcaggaggucguggugcucgggucccaggagggcgcgaugcacaccgcccugacgggggccaccgagauccagaacagcggcgggaccuccaucuucgccggccaccugaagugccgccucaagauggacaagcuggagcugaagggcaugagcuacgccaugugcaccaacacguucguccucaagaaggagguguccgagacccagcacgggaccauccugaucaagguggaguacaagggcgaggacgcgccgugcaagauccccuucagcaccgaggacgggcagggcaaggcccacaacggccggcugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccgcggcgcccggcgcauggccauccucggcgacaccgcgugggacuucggguccgugggcggggugcugaacagccugggcaagaugguccaccagaucuucggguccgccuacacggcccucuucagcggcguguccugggugaugaagaucggcaucgggguccugcugaccuggaucggccucaacagcaagaacaccuccaugagcuucuccugcaucgccaucgggaucaucacccuguaccugggcgccguggugcaggcggacauggggugcgucaucaacuggaagggcaaggagcucaagugcggcagcgggaucuucgugacgaacgaggugcacaccuggaccgagcaguacaaguuccaggccgacucccccaagcgccuggccaccgccaucgccggcgcgugggagaacggggucugcggcauccggagcacgacccgcauggagaaccugcucuggaagcagaucgccaacgagcugaacuacauccugugggagaacaacaucaagcucaccgugguggucggggacaucaucggcgugcuggagcagggcaagcggacccugacgccccagccgauggagcucaaguacuccuggaagaccuggggcaagagcaagaucgugaccgccgagacccagaacuccagcuucaucaucgacggccccaacacgcccgagugccccuccgccagccgcgcguggaacgucugggagguggaggacuacggguucggcguguucaccaccaacaucuggcugaagcugcgggaggucuacacccagcucugcgaccaccgccugaugagcgccgccgugaaggacgagcgggccgugcacgccgacaugggcuacuggaucgagucccagaagaacgggagcuggaagcuggagaaggcgucccucaucgaggucaagaccugcacguggcccaagagccacacccugugguccaacggcgugcuggagagcgacaugaucauccccaagucccucgccgggcccaucagccagcacaaccaccgcccgggcuaccacacccagaccgccgggcccuggcaccugggcaagcuggagcucgacuucaacuacugcgagggcacgaccguggucaucaccgagaacugcgggacccggggccccgcccugcgcacgaccaccguguccgggaagcugauccacgaguggugcugccggagcugcacccugccgccccugcgcuacaugggcgaggacgggugcugguacggcauggagauccggcccaucuccgagaaggaggagaacauggucaagagccuggucuccgccggcagcgggaagguggacaacuucacgaugggcgugcucugccuggcgauccuguucgaggaggucaugcgcgggaaguucggcaagaagcacaugaucgccgggguguucuucaccuucgugcuccugcuguccggccagaucaccuggcgggacauggcccacacccucaucaugaucggcagcaacgccuccgaccgcauggggaugggcgucacguaccuggcccugaucgcgaccuucaagauccagcccuuccucgcccugggguucuuccugcggaagcucaccagccgcgagaaccugcugcucggcgugggccuggccauggccaccacgcugcagcuccccgaggacaucgagcagauggcgaacgggaucgcccugggccugauggcccucaagcugaucacccaguucgagaccuaccagcuguggaccgcccucaucagccugacgugcuccaacaccauguucacccugaccguggccuggcggacggcgacccucauccuggccggggucagccugcucccggugugccaguccagcuccaugcgcaagaccgacuggcugcccauggccgucgccgccaugggcgugccgccccucccccucuucaucuucagccugaaggacacccugaagcgccgguccuggccccucaacgagggggugauggcggucggccuggugagcauccuggccuccagccuccugcgcaacgacgugcccauggccggcccccuggucgccgggggccuccugaucgccugcuacgugaucacggggaccuccgcggaccugaccguggagaaggccgccgacaucaccugggaggaggaggccgagcagacgggcgucagccacaaccucaugaucaccguggacgacgacgggaccaugcggaucaaggacgacgagaccgagaacauccugaccgugcugcucaagacggcccugcugaucgucuccggcguguucccguacagcauccccgcgacccuccugguguggcacaccuggcagaagcagacccagcgcuccggcguccugugggacgugcccuccccgcccgagacgcagaaggccgagcucgaggaggggguguaccggaucaagcagcagggcaucuucgggaagacccaggucggcgugggggugcagaaggagggcgucuuccacaccauguggcacgugacccgcggcgccgugcugacguacaacgggaagcggcuggagcccaacugggccuccgucaagaaggaccucgugagcuacggcgggggcuggcgccuguccgcgcaguggcagaagggggaggaggugcaggucaucgccguggagcccggcaagaaccccaagaacuuccagaccaugccgggcaccuuccagaccacgaccggggagaucggcgccaucgcccuggacuucaagcccgggaccagcggcagccccaucaucaaccgggagggcaagguggucgggcuguacggcaacgggguggugaccaagaacggcggguacgucuccggcaucgcccagacgaacgcggagccggacggccccacccccgagcucgaggaggagauguucaagaagcgcaaccugaccaucauggaccugcaccccgggagcggcaagacccggaaguaccucccggccaucgugcgcgaggccaucaagcggcgccugcggacgcugauccucgcccccacccgcguggucgccgcggagauggaggaggcccugaaggggcugcccauccgguaccagaccaccgccacgaaguccgagcacaccggccgcgagaucguggaccucaugugccacgccaccuucaccaugcggcugcugagccccgugcgcgucccgaacuacaaccucaucaucauggacgaggcccacuucacggaccccgcguccaucgccgcccggggguacaucagcacccgcgugggcaugggcgaggccgcggccaucuucaugaccgccacgccgcccgggacggccgacgccuucccgcaguccaacgcgcccauccaggacgaggagcgcgacauccccgagcggagcuggaacuccggcaacgaguggaucaccgacuucgccgggaagaccgugugguucguccccagcaucaaggccggcaacgacaucgccaacugccugcgcaagaacgggaagaaggugauccagcugucccggaagaccuucgacacggaguaccagaagaccaagcucaacgacugggacuucguggucaccaccgacaucagcgagaugggcgccaacuucaaggcggaccgcgugaucgacccgcggcgcugccugaagcccgugauccugacggacggccccgagcgggucauccucgccgggcccaugccggugaccgccgccuccgccgcgcagcgccggggccgcguggggcggaacccccagaaggagaacgaccaguacaucuucaccggccagccccugaacaacgacgaggaccacgcccacuggaccgaggccaagaugcugcucgacaacaucaacacccccgaggggaucaucccggcccuguucgagcccgagcgcgagaaguccgcggccaucgacggcgaguaccggcugaagggcgagucccgcaagacguucgucgagcucaugcggcgcggggaccugcccguguggcuggcccacaaggucgccagcgagggcaucaaguacaccgaccggcgcuggugcuucgacgggcagcggaacaaccagauccucgaggagaacauggacguggagaucuggaccaaggagggcgagaagaagaagcugcgcccccgcuggcuggacgcccggaccuacuccgacccgcucgcgcugaaggaguucaaggacuucgccgccggccgcaagagcaucgcccuggaccucgugacggagaucgggcggguccccucccaccuggcccaccgcacccggaacgcgcuggacaaccucgugaugcugcacaccagcgagcacggcgggcgcgccuaccggcacgccguggaggagcugcccgagaccauggagacgcuccugcugcucggccugaugauccugcucaccgggggcgccaugcuguuccugaucagcggcaaggggaucggcaagaccuccaucgggcucaucugcgucaucgccagccgcuccaugagcuggauggcggagaucccgcugcaguggaucgccuccgccaucgugcuggaguucuucaugauggugcuccugauccccgagcccgagaagcagcggacgccccaggacaaccagcuggccuacgucgugaucggcauccucacgcuggccgcgaucaucgccgccaacgagauggggcugcucgagaccaccaagcgcgaccugggcaugagcaaggagccgggcguggucucccccaccagcuaccuggacguggaccuccaccccgccuccgcguggacgcuguacgccguggccaccaccgucaucacccccaugcugcggcacacgaucgagaacagcaccgccaacgugucccucgccgcgaucgccaaccaggccgugguccugauggggcuggacaagggcuggccgaucagcaagauggaccucggggugccccugcuggcccucggcugcuacucccaggugaacccccugacccugaccgccgcgguccuccugcugaucacgcacuacgccaucaucgggcccggccuccaggccaaggccacccgcgaggcccagaagcggaccgcggccggcaucaugaagaacccgaccguggacgggaucaugacgaucgaccuggaccccgugaucuacgacagcaaguucgagaagcagcugggccaggucaugcuccuggugcugugcgccgugcagcuccugcugaugcgcaccuccugggcccucugcgaggcgcugacccuggccaccgggcccaucacgacccucugggagggcagccccggcaaguucuggaacaccaccaucgccgucuccauggccaacaucuuccgggggagcuaccuggccggcgcggggcuggccuucuccaucaugaaguccgugggcacggggaagcgcggcaccggcagccagggggagacccucggcgagaaguggaagaagaagcugaaccagcugucccggaaggaguucgaccucuacaagaaguccgggaucaccgagguggaccgcaccgaggccaaggagggccugaagcgcggggagaucacgcaccacgccgucucccgcggcagcgccaagcugcagugguucguggagcggaacauggugaucccggagggccgcgucaucgaccucgggugcggccgcgggggcugguccuacuacugcgcggggcugaagaaggugaccgaggugcggggcuacaccaagggcgggcccggccacgaggagcccguccccaugagcaccuacggguggaacaucgugaagcugauguccggcaaggacguguucuaccucccgcccgagaagugcgacacgcugcugugcgacaucggggagagcucccccagccccaccgucgaggagucccgcaccauccgggugcugaagaugguggagccguggcucaagaacaaccaguucugcaucaagguccugaaccccuacaugcccaccgugaucgagcaccuggagcgccuccagcggaagcacggcggcaugcuggugcgcaacccccugagccggaacuccacgcacgagauguacuggaucagcaacgggaccggcaacaucgucgccuccgugaacauggugagccgccuccugcugaaccgguucaccaugacccaccgccggccgacgaucgagaaggacgucgaccucggggccggcacccgccacgugaacgccgagcccgagacccccaacauggacgugaucggcgagcggaucaagcgcaucaaggaggagcacaacuccaccuggcacuacgacgacgagaacccguacaagacgugggccuaccacgggagcuacgaggucaaggcgaccggcuccgccagcagcaugaucaacgggguggucaagcugcugaccaagcccugggacguggugcccauggucacccagauggccaugacggacaccacccccuucggccagcagcggguguucaaggagaagguggacacccgcacgccgcgguccaugcccgggacccgccgggucaugggcaucaccgccgaguggcucuggcgcacccugggccgcaacaagaagccccggcugugcacgcgcgaggaguucaccaagaaggugcggaccaacgcggccaugggggccguguucaccgaggagaaccagugggacagcgccaaggccgcggucgaggacgaggacuucuggaagcucguggaccgcgagcgggagcugcacaagcugggcaagugcggguccugcguguacaacaugaugggcaagcgcgagaagaagcucggggaguucggcaaggccaagggcagccgggccaucugguacauguggcugggggcccgcuaccuggaguucgaggcccucggcuuccugaacgaggaccacugguucucccgggagaacagcuacuccggggucgagggcgaggggcugcacaagcucggcuacauccugcgcgacaucagcaagauccccggcggggcgauguacgccgacgacacggccggcugggacacccggaucaccgaggacgaccugcacaacgaggagaagaucacccagcagauggacccggagcaccgccagcucgccaacgccaucuucaagcugacguaccagaacaagguggugaagguccagcggcccacccccaccgggaccgugauggacaucaucucccgcaaggaccagcggggcagcggccagguggggaccuacggccugaacacguucaccaacauggaggcgcagcucauccgccagauggagggggagggcguccuguccaaggccgaccuggagaacccccaccucccggagaagaagaucacccaguggcuggagaccaaggggguggagcggcugaagcgcauggccaucagcggcgacgacugcguggucaagcccaucgacgaccgguucgccaacgcccuccuggcgcugaacgacaugggcaaggugcgcaaggacaucccccaguggcagcccuccaagggguggcacgacuggcagcaggucccguucugcagccaccacuuccacgagcucaucaugaaggacggccggaagcuggucgugcccugccgcccccaggacgagcugaucgggcgcgcccggaucucccagggcgccggguggagccuccgcgagacggccugccugggcaaggcguacgcccagauguggucccugauguacuuccaccggcgcgaccuccggcuggccagcaacgccaucugcuccgccgugcccguccacugggugccgaccagccgcaccaccuggagcauccacgcgcaccaccaguggaugacgaccgaggacaugcugaccguguggaaccgggucuggaucgaggacaaccccuggauggaggacaagacccccgugacgaccugggagaacgugcccuaccucggcaagcgcgaggaccaguggugcgggucccugaucggccugaccagccgggccaccugggcccagaacaucccgacggccauccagcagguccgcucccucaucgggaacgaggaguuccuggacuacaugcccagcaugaagcgguuccgcaaggaggaggaguccgagggcgccaucugguga

SEQ ID NO: 9871 - RNA, 9873 nt, Artificial Sequence
  derived and/or modified CDS sequence (opt1) from DENV-3__JF808122__SS-prME
accagccugugccugaugaugauccugcccgccgcccuggccuuccaccucaccagccgggacggggagccgcggaugaucguggggaagaacgagcgcggcaagagccugcuguucaagaccgccagcgggaucaucaagugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggugaucuucauccugcugaugcucgugacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggcgccccaccuggcgacccuccgcaagcugugcaucgagggcaagaucacgaacaucaccaccgacagccggugcccgacccagggcgaggccgugcugcccgaggagcaggaccagaacuacgucugcaagcacacguacguggaccgcggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggccagcacgaccgaggcgauccugccggaguacggcacccuggggcucgagugcagcccccggaccggccuggacuucaacgagaugauccugcucaccaugaagaacaaggccuggauggugcaccgccagugguucuucgaccugccccugcccuggacgagcggcgccaccaccgagaccccgacguggaaccggaaggagcuccuggugaccuucaagaacgcccacgccaagaagcaggaggucguggugcuggggucccaggagggcgcgaugcacaccgcccucaccggggccacggagauccagaacagcggcgggaccuccaucuucgccggccaccugaagugccgccugaagauggacaagcucgagcugaagggcaugagcuacgccaugugcaccaacaccuucguccugaagaaggagguguccgagacgcagcacgggaccauccucaucaagguggaguacaagggcgaggacgcgcccugcaagauccccuucagcaccgaggacgggcagggcaaggcccacaacggccggcugaucaccgccaaccccgucgugacgaagaaggaggagccggugaacaucgaggccgagccgcccuucggggagagcaacaucgucaucggcaccggggacaacgcgcugaagaucaacugguacaagaagggcuccagcaucgggaagauguucgaggccaccgcccgcggcgcccggcgcauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccggagcacgacccgcauggagaaccugcuguggaagcagaucgccaacgagcucaacuacauccugugggagaacaacaucaagcugaccgugguggucggggacaucaucggcgugcucgagcagggcaagcggacccugacgccgcagcccauggagcugaaguacuccuggaagaccugggggaaggccaagaucgugaccgccgagacccagaacagcuccuucaucaucgacggccccaacacgcccgagugcccgagcgcgucccgcgccuggaacgucugggagguggaggacuacggguucggcguguucaccaccaacaucuggcucaagcugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagaccugcacguggcccaagucccacacccucuggagcaacggcgugcuggaguccgacaugaucauccccaagagccuggccgggccgaucucccagcacaaccaccgccccggcuaccacacccagaccgccgggcccuggcaccucggcaagcuggagcuggacuucaacuacugcgagggcacgaccguggucaucaccgagaacugcgggacccggggccccagccuccgcacgaccaccguguccgggaagcugauccacgaguggugcugccggagcugcacccugccgccccuccgcuacaugggcgaggacgggugcugguacggcauggagauccggcccaucuccgagaaggaggagaacauggucaagagccuggucuccgccggcagcgggaagguggacaacuucacgaugggcgugcugugccucgcgauccuguucgaggaggucaugcgcgggaaguucggcaagaagcacaugaucgccgggguguucuucaccuucgugcugcuccuguccggccagaucaccuggcgggacauggcccacacccugaucaugaucggcagcaacgccuccgaccgcauggggaugggcgucacguaccucgcccugaucgcgaccuucaagauccagcccuuccuggcccucggguucuuccugcggaagcugaccagccgcgagaaccuccugcugggcgugggccucgccauggccaccacgcugcagcugccggaggacaucgagcagauggcgaacgggaucgcccucggccugauggcccugaagcucaucacccaguucgagaccuaccagcuguggaccgcccugaucagccucacgugcuccaacaccauguucacccugaccguggccuggcggacggcgacccugauccucgccggggucagccugcugcccgugugccaguccagcuccaugcgcaagaccgacuggcuccccauggccgucgccgccaugggcgugcccccgcugccccuguucaucuucagccucaaggacacccugaagcgccgguccuggccccugaacgagggggugauggcggucggccucgugagcauccuggccuccagcuuccugcgcaacgacgugcccauggccggcccgcucgucgccgggggccugcugaucgccugcuacgugaucacggggaccuccgcggaccucaccguggagaaggccgccgacaucaccugggaggaggaggccgagcagacgggcgucagccacaaccugaugaucaccguggacgacgacgggaccaugcggaucaaggacgacgagaccgagaacauccugaccgugcuccugaagacggcccugcucaucgucuccggcguguuccccuacagcauccccgcgacccugcugguguggcacaccuggcagaagcagacccagcgcuccggcguccucugggacgugcccagcccgcccgagacgcagaaggccgagcuggaggaggggguguaccggaucaagcagcagggcaucuucgggaagacccaggucggcgugggggugcagaaggagggcgucuuccacaccauguggcacgugacccgcggcgccgugcugacguacaacgggaagcggcucgagcccaacugggccuccgucaagaaggaccugaucagcuacggcgggggcuggcgccuguccgcgcaguggcagaagggggaggagguccaggugaucgccgucgagcccggcaagaacccgaagaacuuccagaccaugcccggcaccuuccagaccacgaccggggagaucggcgccaucgcccucgacuucaagcccgggaccagcggcagcccgaucaucaaccgggagggcaaggugguggggcuguacggcaacggggucgugaccaagaacggcggguacguguccggcaucgcccagacgaacgcggagcccgacggccccacccccgagcuggaggaggagauguucaagaagcgcaaccugaccaucauggaccuccacccggggagcggcaagacccggaaguaccugcccgccaucguccgcgaggccaucaagcggcgccugcggacgcucauccuggcccccacccgcgugguggccgcggagauggaggaggcccugaaggggcuccccauccgguaccagaccaccgccacgaaguccgagcacaccggccgcgagaucgucgaccugaugugccacgccaccuucaccaugcggcugcucagcccggugcgcgugcccaacuacaaccugaucaucauggacgaggcccacuucacggaccccgcguccaucgccgcccggggguacaucagcacccgcgucggcaugggcgaggccgcggccaucuucaugaccgccacgccgcccgggacggccgacgccuucccccaguccaacgcgcccauccaggacgaggagcgcgacauccccgagcggagcuggaacuccggcaacgaguggaucaccgacuucgccgggaagaccgugugguucgugcccagcaucaaggccggcaacgacaucgccaacugccugcgcaagaacgggaagaaggucauccagcucucccggaagaccuucgacacggaguaccagaagaccaagcugaacgacugggacuucguggugaccaccgacaucagcgagaugggcgccaacuucaaggcggaccgcgucaucgacccccggcgcugccugaagcccgugauccucacggacggccccgagcgggugauccuggccgggccgaugcccgucaccgccgccuccgccgcgcagcgccggggccgcguggggcggaacccccagaaggagaacgaccaguacaucuucaccggccagccccugaacaacgacgaggaccacgcccacuggaccgaggccaagaugcuccuggacaacaucaacaccccggaggggaucauccccgcccuguucgagcccgagcgcgagaaguccgcggccaucgacggcgaguaccggcucaagggcgagucccgcaagacguucguggagcugaugcggcgcggggaccugcccgucuggcucgcccacaagguggccagcgagggcaucaaguacaccgaccggaaguggugcuucgacgggcagcgcaacaaccagauccuggaggagaacauggacgucgagaucuggaccaaggagggcgagaagaagaagcugcggccgcgcuggcucgacgcccgcaccuacuccgacccccuggcgcugaaggaguucaaggacuucgccgccggccgcaagagcaucgcccucgaccuggugacggagaucgggcgcgugcccucccaccuggcccaccggacccgcaacgcgcucgacaaccuggucaugcugcacaccagcgagcacggcgggcgggccuaccgccacgccguggaggagcucccggagaccauggagacgcugcugcuccugggccugaugauccuccugaccgggggcgccaugcuguuccucaucagcggcaaggggaucggcaagaccuccaucgggcugaucugcgugaucgccagcuccggcaugagcuggauggcggagaucccccugcaguggaucgccuccgccaucguccucgaguucuucaugauggugcugcugauccccgagcccgagaagcagcggaccccgcaggacaaccagcucgccuacguggucaucgggauccugacgcuggccgcgaucaucgccgccaacgagaugggccuccuggagaccaccaagcgcgaccugggcaugagcaaggagcccgggguggugucccccaccagcuaccucgacgucgaccugcaccccgccuccgcguggacgcuguacgccguggccaccaccgugaucaccccgaugcuccggcacacgaucgagaacagcaccgccaacgucucccuggccgcgaucgccaaccaggccguggugcugaugggccucgacaagggguggcccaucagcaagauggaccugggcgucccccugcucgcccuggggugcuacucccaggugaacccccugacccucaccgccgcggugcugcugcucaucacgcacuacgccaucaucggcccgggccugcaggccaaggccacccgcgaggcccagaagcggaccgcggccgggaucaugaagaaccccaccgucgacggcaucaugacgaucgaccuggaccccgugaucuacgacagcaaguucgagaagcagcucggccaggugaugcugcugguccucugcgccgugcagcugcugcucaugcgcaccuccugggcccugugcgaggcgcugacccucgccaccggccccaucacgacccugugggagggcagcccggggaaguucuggaacaccaccaucgccguguccauggccaacaucuuccggggcagcuaccuggccggggcgggccucgccuucuccaucaugaaguccgucgggacgggcaagcgcggcaccgggagccagggcgagacccugggggagaaguggaagaagaagcugaaccagcucucccggaaggaguucgaccuguacaagaaguccggcaucaccgagguggaccgcaccgaggccaaggaggggcugaagcggggcgagaucacgcaccacgccgugucccgcggcagcgccaagcuccagugguucgucgagcggaacauggugauccccgaggggcgcgugaucgaccugggcugcgggcggggcgggugguccuacuacugcgcgggccugaagaaggucaccgaggugcgcggcuacaccaagggcgggcccgggcacgaggagcccgugccgaugagcaccuacggcuggaacaucgucaagcucauguccgggaaggacguguucuaccugccgcccgagaagugcgacacgcugcucugcgacaucggcgagagcucccccagcccgaccguggaggagucccgcaccauccggguccugaagaugguggagcccuggcugaagaacaaccaguucugcaucaaggugcugaaccccuacaugcccaccgucaucgagcaccucgagcgccugcagcggaagcacggcgggaugcuggugcgcaacccgcucagccggaacuccacgcacgagauguacuggaucagcaacggcaccgggaacaucguggccuccgucaacauggugagccgccugcugcucaaccgguucaccaugacccaccgccggcccacgaucgagaaggacguggaccugggcgccggcacccgccacgucaacgccgagcccgagaccccgaacauggacgugaucggggagcggaucaagcgcaucaaggaggagcacaacuccaccuggcacuacgacgacgagaaccccuacaagacgugggccuaccacggcagcuacgaggugaaggcgaccggguccgccagcagcaugaucaacggcgucgugaagcugcucaccaagcccugggacgucgugcccauggugacccagauggccaugacggacaccaccccguucgggcagcagcgggucuucaaggagaagguggacacccgcacgccccgguccaugcccggcacccgccgggugaugggcaucaccgccgaguggcuguggcgcacccuggggcggaacaagaagccccgccucugcacgcgcgaggaguucaccaagaagguccggaccaacgcggccaugggcgccguguucaccgaggagaaccagugggacagcgccaaggccgcgguggaggacgaggacuucuggaagcuggucgaccgcgagcgggagcugcacaagcucgggaagugcggcuccugcguguacaacaugauggggaagcgcgagaagaagcugggcgaguucggcaaggccaacgggagccgggccaucugguacauguggcugggcgcccgcuaccucgaguucgaggcccugggguuccugaaggaguaccacugguucucccgggagaacagcuacuccggcguggagggggagggccuccacaagcugggcuacauccugcgcgacaucagcaagauccccggcggggcgauguacgccgacgacacggccgggugggacacccggaucaccgaggacgaccuccacaacgaggagaagaucacccagcagauggaccccgagcaccgccagcuggccaacgccaucuucaagcugacguaccagaacaaggucgugaaggugcagcggcccacccccaccgggaccgucauggacaucaucucccgcaaggaccagcggggcagcggccaggugggcaccuacgggcucaacacguucaccaacauggaggcgcagcugauccgccagauggagggcgagggggugcuguccaaggccgaccucgagaacccgcaccuccccgagaagaagaucacccaguggcuggagaccaagggcgucgagcggcucaagcgcauggccaucagcggcgacgacugcguggugaagcccaucgacgaccgguucgccaacgcccugcuggcgcucaacgacacggggaagguccgcaaggacaucccccaguggcagccguccaagggcuggcacgacuggcagcagguccccuucugcagccaccacuuccacgagcugaucaugaaggacgggcggaagcuggugguccccugccgcccccaggacgagcucaucggccgggcccgcaucucccagggggccggcuggagccugcgcgagaccgccugccugggcaaggcguacgcccagauguggucccucauguacuuccaccggcgcgaccugcggcuggccagcaacgccaucugcuccgccgugccggugcacuggguccccaccagccgcaccacguggagcauccacgcgcaccaccaguggaugaccaccgaggacaugcucaccguguggaaccggguguggaucgaggacaaccccuggauggaggacaagacgcccgucaccaccugggagaacgugccguaccuggggaagcgcgaggaccaguggugcggcucccugaucgggcucaccagccgggccacgugggcccagaacauccccaccgccauccagcagguccgcucccugaucggcaacgaggaguuccuggacuacaugcccagcaugaagcgguuccgcaaggaggaggaguccgagggggccaucugguga

SEQ ID NO: 9872 - RNA, 9873 nt, Artificial Sequence
  derived and/or modified CDS sequence (opt1) from DENV-3__GQ466079__SS-prME
accagccugugccucaugaugauccugcccgccgcccuggcguuccaccucaccagccgcgacggcgagccgcggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaccaucggcgugcucgagcagggcaagcgcacgcugacgccccagccgauggagcugaaguacuccuggaagaccugggggaaggccaagaucgugaccgccgagacgcagaacagcuucuucaucaucgacggccccaacacccccgagugccccuccgcgagccgggccuggaacgucugggagguggaggacuacggguucggcguguucaccaccaacaucuggcucaagcugcgcgaggucuacacccagcugugcgaccaccggcucauguccgccgccgugaaggacgagcgcgccgugcacgcggacaugggcuacuggaucgagagccagaagaacgggagcuggaagcuggagaaggccucccugaucgaggucaagacgugcaccuggcccaagucccacacccucugguccaacggcgugcuggagagcgacaugaucauccccaagucccuggccgggcccaucagccagcacaaccaccggccgggcuaccacacccagacggccgggcccuggcaccucgagaaccuggagcuggacuucaccuacugcgagggcaccaccguggucaucacggagaacugcggcacccgcgggcccucccuccggaccaccacggugagcggcaagcugauccacgaguggugcugccgcuccugcacccugcccccgcuccgguacaugggggaggacggcugcugguacgggauggagauccgccccaucagcgagaaggaggagaacauggugaagucccuggucagcgccggcuccggcaagguggacaacuucaccauggggauccugugccucgcgauccuguucgaggaggugaugcggggcaaguucgggaagaagcacaugaucgccggcgucuucuucaccuucgugcugcuccugagcgggcagaucacguggcgcgacauggcccacacccugaucaugaucggcuccaacgccagcgaccggaugggcaugggggugaccuaccucgcccugaucgcgaccuucaagauccagcccuuccuggcccucggcuucuuccugcgcaagcugacgucccgggagaaccuccugcugggggucggccucgccauggccaccacccugcagcugcccgaggacaucgagcagauggcgaacggcaucgcccucgggcugauggcccugaagcucaucacccaguucgagacguaccagcuguggaccgcccugaucagccugaccugcagcaacaccaucuucacgcugaccguggccuggcgcaccgcgacccugauccucgccggcgugucccugcugccggucugccagagcuccagcaugcggaagacggacuggcuccccaugaccguggccgccaugggggugccgccccucccgcuguucaucuucucccucaaggacacccugaagcgccgcagcuggccccugaacgagggcgugauggccguggggcucgucuccauccuggcgagcucccugcuccggaacgacgugcccauggccggcccccugguggccggcgggcugcucaucgccugcuacgucaucaccggcacgagcgccgaccugaccguggagaaggcggccgacgugaccugggaggaggaggccgagcagaccggggucucccacaaccugaugaucaccguggacgacgacggcacgaugcgcaucaaggacgacgagaccgagaacauccucaccgugcugcugaagaccgcccuccugaucgucagcgggaucuucccguacuccauccccgccacgcugcucguguggcacaccuggcagaagcagacccagcggagcggcgugcugugggacguccccagcccgcccgagacccagaaggcggagcuggaggagggcguguaccgcaucaagcagcaggggauccucggcaagacccaggugggggucggcgugcagaaggaggggguguuccacaccauguggcacgucacccggggcgccgugcugacccacaacggcaagcgccuggagcccaacugggccagcgugaagaaggaccucaucuccuacgggggcggguggcggcugagcgcccaguggcagaagggcgaggagguccaggugaucgcgguggagcccgggaagaaccccaagaacuuccagacgaugcccggcaccuuccagaccaccacgggcgagaucggggccaucgcccuggacuucaagcccggcaccuccgggagccccaucaucaaccgcgagggcaaggucgugggccuguacgggaacggcguggucaccaagaacgggggcuacgugagcgggaucgcccagaccaacgccgagccggacggccccacgcccgagcucgaggaggagauguucaagaagcggaaccugaccaucauggaccugcaccccggcuccgggaagacccgcaaguaccucccggcgaucgugcgggaggccaucaagcgccggcugcgcacccugauccucgcccccacgcgggucguggccgccgagauggaggaggcgcugaagggccugcccauccgcuaccagaccaccgccaccaagagcgagcacacggggcgggagaucguggaccucaugugccacgccaccuucaccaugcgccugcugucccccguccgggugccgaacuacaaccucaucaucauggacgaggcccacuucaccgaccccgccagcaucgcggcccgcggcuacaucuccacgcggguggggaugggcgaggccgccgcgaucuucaugagcgccacgccgcccggcaccgccgacgccuucccgcaguccaacgcccccauccaggacgaggagcgcgacauccccgagcgcagcuggaacuccgggaacgaguggaucaccgacuucgcgggcaagacggucugguucgugcccagcaucaaggccgggaacgacaucgccaacugccugcggaagaacggcaagaaggugauccagcugucccgcaagaccuucgacaccgaguaccagaagaccaagcucaacgacugggacuucgucgugacgaccgacaucagcgagaugggggccaacuucaaggccgaccgggugaucgacccgcgccggugccugaagcccgucauccugaccgacggccccgagcgcgugauccucgcgggccccaugccggugaccgccgccuccgccgcccagcggcgcgggcgggucggccgcaacccccagaaggagaacgaccaguacaucuucaccgggcagccccugaacaacgacgaggaccacgcgcacuggacggaggccaagaugcugcucgacaacaucaacacccccgagggcaucaucccggcccuguucgagcccgagcgggagaaguccgccgcgaucgacggggaguaccgccugaagggcgagucccggaagaccuucguggagcucaugcgccggggcgaccugcccguguggcuggcccacaaggucgccagcgaggggaucaaguacaccgaccgcaaguggugcuucgacggccagcggaacaaccagauccucgaggagaacauggacguggagaucuggacgaaggagggggagaagaagaagcugcgcccccgguggcuggacgcccgcaccuacuccgacccgcucgcccugaaggaguucaaggacuucgcggccggccgcaagagcaucgcccuggaccucgucaccgagaucggccgggugcccucccaccuggcccaccgcacccggaacgcccuggacaaccucgugaugcugcacacgagcgagcacgggggccgcgcguaccggcacgccgucgaggagcugcccgagaccauggagacccuccugcugcucgggcugaugauccugcucaccggcggggccaugcuguuccugaucagcggcaagggcaucgggaagacguccaucggccucaucugcgugaucgccagcuccgggaugcuguggauggccgagaucccgcugcaguggaucgcgagcgccaucgugcucgaguucuucaugaugguccugcugauccccgagcccgagaagcagcgcacgccccaggacaaccagcucgccuacguggugaucggcauccugacccuggccgccaucaucgcggccaacgagauggggcuccuggagaccacgaagcgggaccugggcauguccaaggagccgggcgucgugagccccaccuccuaccucgacguggaccugcaccccgccagcgccuggacccuguacgcggucgccaccacggugaucacccccaugcuccgccacaccaucgagaacuccaccgccaacgugagccuggccgccaucgcgaaccaggccgucgugcugauggggcucgacaagggcuggccgaucuccaagauggaccugggggugccccugcucgcccugggcugcuacagccaggucaacccccugacgcucaccgccgccgugcugcugcucaucacccacuacgcgaucaucgggcccggccugcaggccaaggccacccgggaggcccagaagcgcacggccgcgggcaucaugaagaacccgaccguggacgggaucaucaccaucgaccuggaccccgucaucuacgacuccaaguucgagaagcagcucggccaggugaugcugcuggugcucugcgccguccagcugcugcucaugcggaccagcugggcccugugcgaggcccugacgcucgcgaccgggcccaucaccacccugugggagggcucccccggcaaguucuggaacacgaccaucgccgugagcauggccaacaucuuccgcggguccuaccuggccggcgccgggcucgcguucagcaucaugaaguccgugggcaccgggaagcggggcaccggcagccagggggagacccugggcgagaaguggaagaagaagcugaaccagcucagccgcaaggaguucgaccuguacaagaaguccgggaucacggaggucgaccggaccgaggccaaggagggccugaagcgcggggagaccacccaccacgccgugagccggggcuccgccaagcuccaguggcugguggagcgcaacauggucaucccggagggccgggugaucgaccuggggugcggccgcgggggcuggagcuacuacugcgccgggcucaagaaggugacggagguccggggcuacaccaagggcgggcccggccacgaggagcccgugcccauguccaccuacggguggaacaucgugaagcugaugagcggcaaggacgucuucuaccugccgcccgagaagugcgacacccugcucugcgacaucggggaguccagccccucccccacgguggaggagagccgcaccauccgcgugcugaagauggucgagccguggcugaagaacaaccaguucugcaucaaggugcucaaccccuacaugcccgcggugaucgagcaccuggagcggcugcagcgcaagcacggcggcaugcucguccggaacccccugucccgcaacagcacccacgagauguacuggaucuccaacgggaccggcaacaucgugagcuccgugaacauggucagccggcugcuccugaaccgcuucacgaugacccaccggcgcccgaccaucgagaaggacguggaccugggggccggcacccggcacgugaacgccgagcccgagacgcccaacauggacgucaucggcgagcgcaucaagcggaucaaggaggagcacaacuccaccuggcacuacgacgacgagaacccguacaagaccugggccuaccacgggagcuacgaggugaaggccaccggcuccgcgagcagcaugaucaacgggguggucaagcuccugacgaagcccugggacgugguccccauggugacccagauggccaugaccgacaccacgcccuucggccagcagcgcguguucaaggagaaggucgacacccggaccccgcgccccaugcccgggacccggaaggugauggagaucacggccgaguggcuguggcgcacccucggccggaacaagcgcccccggcugugcacccgcgaggaguucaccaagaaggugcgcacgaacgccgcgaugggcgccgucuucaccgaggagaaccagugggacuccgccaaggccgccguggaggacgaggaguucuggaagcugguggaccgggagcgcgagcuccacaagcuggggaagugcggcagcugcgucuacaacaugauggggaagcgggagaagaagcugggcgaguucgggaaggcgaagggcucccgcgccaucugguacauguggcucggcagccgguaccuggaguucgaggcccugggguuccucaacgaggaccacugguucucccgcgagaacagcuacuccggcguggagggggagggccugcacaagcugggguacauccuccgggacaucagcaagaucccgggcggcgccauguacgccgacgacaccgcggggugggacacccgcaucacggaggacgaccugcacaacgaggagaagaucacccagcagauggaccccgagcaccggcugcucgccaacgccaucuucaagcugaccuaccagaacaagguggucaaggugcagcgccccacccccaccggcacggugauggacaucaucucccggaaggaccagcgcgggagcggccaggucggcaccuacgggcugaacaccuucaccaacauggaggcccagcucgugcggcagauggagggcgagggggugcuguccaaggccgaccuggagaacccgcaccuccccgagaagaagaucacgcaguggcuggagaccaagggcgucgagcgccugaagcggauggcgaucagcggggacgacugcguggugaagcccaucgacgaccgcuucgccaacgcccuccuggcccugaacgacaugggcaagguccggaaggacaucccccaguggcagccguccaagggcuggcacgacuggcagcagguccccuucugcagccaccacuuccacgagcucaucaugaaggacgggcgcaagcuggugguccccugccggccccaggacgagcugaucggccgcgcccggaucucccagggggcgggcuggagccuccgcgagaccgccugccuggggaaggccuacgcccagauguggucccugauguacuuccaccgccgggaccuccgccuggcgagcaacgccaucugcuccgccgugccggugcacuggguccccaccagccggacgaccuggagcauccacgcccaccaccaguggaugaccaccgaggacaugcugacgguguggaaccgcguguggaucgaggacaaccccuggauggaggacaagacccccgucaccaccugggagaacgugccguaccucggcaagcgggaggaccaguggugcggcucccugaucgggcugacgagccgcgccaccugggcgcagaacauccccaccgccauccagcagguccggucccucaucggcaacgaggaguuccuggacuacaugcccagcaugaagcgcuuccggaaggaggaggaguccgagggggccaucugguga

SEQ ID NO: 9873 - RNA, 9873 nt, Artificial Sequence
  derived and/or modified CDS sequence (opt1) from DENV-3__FJ898462__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgugacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccauguucacccugaccguggccuggcgcacggcgacccugauccucgccggggucagccugcugccggugugccaguccagcuccaugcggaagaccgacuggcuccccauggccgucgccgccaugggcgugccgccccucccgcuguucaucuucagccucaaggacacccugaagcgccgcuccuggccccugaacgagggggugauggcggucggccucgugagcauccuggccuccagccugcuccggaacgacgugcccauggccggcccccuggucgccgggggccugcucaucgccugcuacgugaucacggggaccuccgcggaccugaccguggagaaggccgccgacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcguguucccguacagcauccccgcgacccugcucguguggcacaccuggcagaagcagacccagcgguccggcguccugugggacgugcccagcccgcccgagacgcagaaggccgagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccuccgucaagaaggaccugaucagcuacggcgggggcuggcggcucuccgcgcaguggcagcgcggggaggagguccaggugaucgccgucgagcccggcaagaaccccaagaacuuccagaccaugcccggcaccuuccagaccacgaccggggagaucggcgccaucgcccuggacuucaagcccgggaccagcggcagccccaucaucaaccgggagggcaaggugguggggcuguacggcaacggggucgugaccaagaacggcggguacguguccggcaucgcccagacgaacgcggagccggacggccccacccccgagcuggaggaggagauguucaagaagcgcaaccucaccaucauggaccugcaccccgggagcggcaagacccggaaguaccugccggccaucguccgcgaggccaucaagcggcgccuccggacgcugauccuggcccccacccgcgugguggccgcggagauggaggaggcccucaaggggcugcccauccgguaccagaccaccgccacgaaguccgagcacaccggccgcgagaucgucgaccugaugugccacgccaccuucaccaugcggcuccugagccccgugcgcgugccgaacuacaaccugaucaucauggacgaggcccacuucacggaccccgcguccaucgccgcccggggguacaucagcacccgcgucggcaugggcgaggccgcggccaucuucaugaccgccacgccgcccgggacggccgacgccuucccgcaguccaacgcgcccauccaggacgaggagcgcgacauccccgagcggagcuggaacuccggcaacgaguggaucaccgacuucgccgggaagaccgugugguucgugcccagcaucaaggccggcaacgacaucgccaacugccuccgcaagaacgggaagaaggucauccagcugucccggaagaccuucgacacggaguaccagaagaccaagcugaacgacugggacuucguggugaccaccgacaucagcgagaugggcgccaacuucaaggcggaccgcgucaucgacccgcggcgcugccucaagcccgugauccugacggacggccccgagcgggugauccuggccgggcccaugccggucaccgccgccuccgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagucccgcaagacguucguggagcugaugcggcgcggggaccuccccgucuggcuggcccacaagguggccagcgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccgcaccuacuccgacccgcuggcgcucaaggaguucaaggacuucgccgccggccgcaagagcaucgcccuggaccuggugacggagaucgggcgcgugcccucccaccucgcccaccggacccgcaacgcgcuggacaaccuggucaugcuccacaccagcgagcacggcgggcgggccuaccgccacgccguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucguccuggaguucuucaugauggugcuccugauccccgagcccgagaagcagcggacgccccaggacaaccagcuggccuacguggucaucgggauccucacgcuggccgcgaucaucgccgccaacgagaugggccugcucgagaccaccaagcgcgaccugggcauguccaaggagccggggguggugagccccaccuccuaccuggacgucgaccuccaccccgccagcgcguggacgcuguacgccguggccaccaccgugaucacccccaugcugcggcacacgaucgagaacuccaccgccaacgucagccucgccgcgaucgccaaccaggccguggugcugaugggccuggacaagggguggccgaucuccaagauggaccucggcgucccccugcuggcccucgggugcuacagccaggugaacccccugacccugaccgccgcggugcuccugcugaucacgcacuacgccaucaucggccccggccuccaggccaaggccacccgcgaggcccagaagcggaccgcggccgggaucaugaagaacccgaccgucgacggcaucaugacgaucgaccuggaccccgugaucuacgacuccaaguucgagaagcagcugggccaggugaugcuccugguccugugcgccgugcagcuccugcugaugcgcaccagcugggcccucugcgaggcgcugacccuggccaccggccccaucacgacccucugggagggcucccccgggaaguucuggaacaccaccaucgccgugagcauggccaacaucuuccggggcuccuaccuggccggggcgggccuggccuucagcaucaugaaguccgucgggacgggcaagcgcggcaccgggagccagggcgagacccucggggagaaguggaagaagaagcugaaccagcugagccggaaggaguucgaccucuacaagaaguccggcaucaccgagguggaccgcaccgaggccaaggaggggcugaagcggggcgagacgacccaccacgccgugagccgcggcuccgccaagcugcagugguucgucgagcggaacauggugaucccggaggggcgcgugaucgaccucggcugcgggcggggcggguggagcuacuacugcgcgggccugaagaaggucaccgaggugcgcggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaucguggaggagagccgcaccauccggguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacgcacgagauguacuggaucuccaacggcaccgggaacaucguggccagcgucaacauggugucccgccuccugcugaaccgguucaccaugacccaccgccggccgacgaucgagaaggacguggaccucggcgccggcacccgccacgucaacgccgagcccgagacccccaacauggacgugaucggggagcggaucaagcgcaucaaggaggagcacaacagcaccuggcacuacgacgacgagaacccguacaagacgugggccuaccacggcuccuacgaggugaaggcgaccgggagcgccuccagcaugaucaacggcgucgugaagcugcugaccaagcccugggacgucgugcccauggugacccagauggccaugacggacaccacccccuucgggcagcagcgggucuucaaggagaagguggacacccgcacgccgcggagcaugcccggcacccgccgggugaugggcaucaccgccgaguggcucuggcgcacccuggggcggaacaagaagccccgccugugcacgcgcgaggaguucaccaagaagguccggaccaacgcggccaugggcgccguguucaccgaggagaaccagugggacuccgccaaggccgcgguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgcgauguacgccgacgacacggccgggugggacacccggaucaccgaggacgaccugcacaacgaggagaagaucacccagcagauggacccggagcaccgccagcucgccaacgccaucuucaagcugacguaccagaacaaggucgugaaggugcagcggcccacccccaccggcaccgucauggacaucaucagccgcaaggaccagcggggcuccggccaggugggcaccuacgggcugaacacguucaccaacauggaggcgcagcucauccgccagauggagggcgagggggugcugagcaaggccgaccuggagaacccccaccucccggagaagaagaucacccaguggcuggagaccaagggcgucgagcggcugaagcgcauggccaucuccggcgacgacugcguggugaagcccaucgacgaccgguucgccaacgcccuccuggcgcugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggccggcuggucccuccgcgagacggccugccugggcaaggcguacgcccagauguggagccugauguacuuccaccggcgcgaccuccggcuggccuccaacgccaucugcagcgccgugcccgugcacugggucccgaccucccgcaccaccuggagcauccacgcgcaccaccaguggaugacgaccgaggacaugcugaccguguggaaccggguguggaucgaggacaaccccuggauggaggacaagacccccgucacgaccugggagaacgugcccuaccucgggaagcgcgaggaccaguggugcggcagccugaucgggcugaccucccgggccaccugggcccagaacaucccgacggccauccagcagguccgcagccucaucggcaacgaggaguuccuggacuacaugcccuccaugaagcgguuccgcaaggaggaggagagcgagggggccaucugguga

SEQ ID NO: 9874 - RNA, 9873 nt, Artificial Sequence
  derived and/or modified CDS sequence (opt1) from DENV-3__KF955473__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgugacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgauccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggccagcacgaccgaggcgauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgccaagaagcaggaggucguggugcuggggucccaggagggcgcgaugcacaccgcccucaccggggccacggagauccagaacagcggcgggaccuccaucuucgccggccaccugaagugccggcugaagauggacaagcucgagcugaagggcaugagcuacgccaugugcaccaacaccuucguccugaagaaggagguguccgagacgcagcacgggaccauccucaucaagguggaguacaagggcgaggacgcgccgugcaagauccccuucagcaccgaggacgggcagggcaaggcccacaacggccgccugaucaccgccaaccccgucgugacgaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacaccgcccuguucagcggcguguccugggugaugaagaucggcaucgggguccuccugacguggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugaccaacgaggugcacacguggaccgagcaguacaaguuccaggccgacucccccaagcgccucgccaccgccaucgccggcgcgugggagaacggggucugcggcauccgcagcaccacgcggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagacgugggggaaggccaagaucgugaccgccgagacccagaacagcuccuucaucaucgacggccccaacacccccgagugccccagcgcgucccgggccuggaacgucugggagguggaggacuacggguucggcguguucacgaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcaccuggccgaagucccacacgcucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcaccacgguggucaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucaccaugggcgugcugugccucgcgauccuguucgaggaggucaugcgggggaaguucggcaagaagcacaugaucgccgggguguucuucacguucgugcugcuccuguccggccagaucaccuggcgcgacauggcccacacccugaucaugaucggcagcaacgccuccgaccggauggggaugggcgucaccuaccucgcccugaucgcgacguucaagauccagcccuuccuggcccucggguucuuccugcgcaagcugaccagccgggagaaccuccugcugggcgugggccucgccauggccaccacccugcagcugcccgaggacaucgagcagauggcgaacgggaucgcccucggccugauggcccugaagcucaucacgcaguucgagaccuaccagcuguggaccgcccugaucagccugaccugcuccaacacgauguucacccugaccguggccuggcgcaccgcgacgcugauccucgccggggucagccugcugccggugugccaguccagcuccaugcggaagaccgacuggcuccccauggccgucgccgccaugggcgugccgccccucccgcuguucaucuucagccucaaggacacccugaagcgccgcuccuggccccugaacgagggggugauggcggucggccucgugagcauccuggccuccagccugcuccggaacgacgugcccauggccggcccccuggucgccgggggccugcucaucgccugcuacgugaucaccgggacguccgcggaccugaccguggagaaggccgccgacaucaccugggaggaggaggccgagcagaccggcgucagccacaaccugaugaucacgguggacgacgacgggaccaugcgcaucaaggacgacgagaccgagaacauccucaccgugcugcugaagaccgcccuccugaucgucuccggcguguucccguacagcauccccgcgacgcugcucguguggcacaccuggcagaagcagacccagcgguccggcguccugugggacgugcccagcccgcccgagacccagaaggccgagcuggaggaggggguguaccgcaucaagcagcagggcaucuucgggaagacgcaggucggcgugggggugcagaaggagggcgucuuccacaccauguggcacgugacccggggcgccgugcucaccuacaacgggaagcgccuggagcccaacugggccuccgucaagaaggaccugaucagcuacggcgggggcuggcggcucuccgcgcaguggcagaagggggaggagguccaggugaucgccgucgagcccggcaagaaccccaagaacuuccagacgaugcccggcaccuuccagaccaccacgggggagaucggcgccaucgcccuggacuucaagcccgggaccagcggcagccccaucaucaaccgcgagggcaaggugguggggcuguacggcaacggggucgugaccaagaacggcggguacguguccggcaucgcccagaccaacgcggagccggacggccccacgcccgagcuggaggaggagauguucaagaagcggaaccucaccaucauggaccugcaccccgggagcggcaagacccgcaaguaccugccggccaucguccgggaggccaucaagcgccggcuccgcacccugauccuggcccccacgcgggugguggccgcggagauggaggaggcccucaaggggcugcccauccgcuaccagaccaccgccaccaaguccgagcacacgggccgggagaucgucgaccugaugugccacgccaccuucaccaugcgccuccugagccccgugcgggugccgaacuacaaccugaucaucauggacgaggcccacuucaccgaccccgcguccaucgccgcccgcggguacaucagcacgcgggucggcaugggcgaggccgcggccaucuucaugaccgccacgccgcccgggaccgccgacgccuucccgcaguccaacgcgcccauccaggacgaggagcgcgacauccccgagcgcagcuggaacuccggcaacgaguggaucacggacuucgccgggaagaccgugugguucgugcccagcaucaaggccggcaacgacaucgccaacugccuccggaagaacgggaagaaggucauccagcugucccgcaagaccuucgacaccgaguaccagaagacgaagcugaacgacugggacuucguggugaccaccgacaucagcgagaugggcgccaacuucaaggcggaccgggucaucgacccgcgccggugccucaagcccgugauccugaccgacggccccgagcgcgugauccuggccgggcccaugccggucacggccgccuccgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagucccggaagaccuucguggagcugaugcgccgcggggaccuccccgucuggcuggcccacaagguggccagcgagggcaucaaguacacggaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcgcucaaggaguucaaggacuucgccgccggccgcaagagcaucgcccuggaccuggugaccgagaucgggcgggugcccucccaccucgcccaccgcacgcggaacgcgcuggacaaccuggucaugcuccacaccagcgagcacggcgggcgcgccuaccggcacgccguggaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugcucuggauggcggagaucccgcugcaguggaucgccagcgccaucguccuggaguucuucaugauggugcuccugauccccgagcccgagaagcagcgcacgccccaggacaaccagcuggccuacguggucaucgggauccucacccuggccgcgaucaucgccgccaacgagaugggccugcucgagacgaccaagcgggaccugggcauguccaaggagccggggguggugagccccaccuccuaccuggacgucgaccuccaccccgccagcgcguggacccuguacgccguggccacgaccgugaucacccccaugcugcgccacaccaucgagaacuccacggccaacgucagccucgccgcgaucgccaaccaggccguggugcugaugggccuggacaagggguggccgaucuccaagauggaccucggcgucccccugcuggcccucgggugcuacagccaggugaacccccugacccugaccgccgcggugcuccugcugaucacccacuacgccaucaucggccccggccuccaggccaaggccacgcgggaggcccagaagcgcaccgcggccgggaucaugaagaacccgaccgucgacggcaucaugaccaucgaccuggaccccgugaucuacgacuccaaguucgagaagcagcugggccaggugaugcuccugguccugugcgccgugcagcuccugcugaugcggacgagcugggcccucugcgaggcgcugacccuggccaccggccccaucaccacgcucugggagggcucccccgggaaguucuggaacaccaccaucgccgugagcauggccaacaucuuccgcggcuccuaccuggccggggcgggccuggccuucagcaucaugaaguccgucgggaccggcaagcggggcacggggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagaccacgcaccacgccgugagccggggcuccgccaagcugcagugguucgucgagcgcaacauggugaucccggaggggcgggugaucgaccucggcugcgggcgcggcggguggagcuacuacugcgcgggccugaagaaggucaccgaggugcggggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacgcacgagauguacuggaucuccaacggcaccgggaacaucguggccagcgucaacauggugucccggcuccugcugaaccgcuucaccaugacccaccggcgcccgacgaucgagaaggacguggaccucggcgccggcacccggcacgucaacgccgagcccgagacccccaacauggacgugaucggggagcgcaucaagcggaucaaggaggagcacaacagcaccuggcacuacgacgacgagaacccguacaagacgugggccuaccacggcuccuacgaggugaaggcgaccgggagcgccuccagcaugaucaacggcgucgugaagcugcugaccaagcccugggacgucgugcccauggugacccagauggccaugacggacaccacccccuucgggcagcagcgcgucuucaaggagaagguggacacccggacgccgcgcagcaugcccggcacccggcgcgugaugggcaucaccgccgaguggcucuggcggacccuggggcgcaacaagaagccccggcugugcacgcgcgaggaguucaccaagaagguccgcaccaacgcggccaugggcgccguguucaccgaggagaaccagugggacuccgccaaggccgcgguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgcgauguacgccgacgacacggccgggugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucagccggaaggaccagcgcggcuccggccaggugggcaccuacgggcugaacacguucaccaacauggaggcgcagcucauccggcagauggagggcgagggggugcugagcaaggccgaccuggagaacccccaccucccggagaagaagaucacccaguggcuggagaccaagggcgucgagcgccugaagcggauggccaucuccggcgacgacugcguggugaagcccaucgacgaccgcuucgccaacgcccuccuggcgcugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggccggcuggucccuccgcgagacggccugccugggcaaggcguacgcccagauguggagccugauguacuuccaccgccgggaccuccgccuggccuccaacgccaucugcagcgccgugcccgugcacugggucccgaccucccggaccaccuggagcauccacgcgcaccaccaguggaugacgaccgaggacaugcugaccguguggaaccgcguguggaucgaggacaaccccuggauggaggacaagacccccgucacgaccugggagaacgugcccuaccucgggaagcgggaggaccaguggugcggcagccugaucgggcugaccucccgcgccaccugggcccagaacaucccgacggccauccagcagguccggagccucaucggcaacgaggaguuccuggacuacaugcccuccaugaagcgcuuccggaaggaggaggagagcgagggggccaucugguga

SEQ ID NO: 9875 - RNA, 9873 nt, Artificial Sequence
  derived and/or modified CDS sequence (opt1) from DENV-3__FJ850079__SS-prME
accagccucugccucaugaugauccugcccgccgcccuggcguuccaccucaccagccgggacggcgagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacguggaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgucggcggggugcucaacagccugggcaagauggugcaccagaucuucggguccgcguacacggcccuguucagcggcgucuccugggugaugaagaucggcaucggggugcuccugaccuggaucggccugaacagcaagaacaccuccaugagcuucuccugcaucgccaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccgucguggugggggacaucaccggcguccucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgccucccgggcguggaacgugugggaggucgaggacuacggguucggcguguucaccaccaacaucuggcucaagcugcgcgagguguacacccagcugugcgaccaccggcucaugagcgccgccgucaaggacgagcgcgccgugcacgccgacaugggcuacuggaucgagagccagaagaacggguccuggaagcuggagaaggcgagccugaucgaggugaagacgugcaccuggccgaagucccacacccucuggagcaacggcguccuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccguggugaucaccgagaacugcgggacgcgcggccccagccuccggaccaccaccgucuccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcggggaggucgacaacuucaccaugggcgugcugugccucgccauccuguucgaggaggugaugcgggggaaguucggcaagaagcacaugaucgcgggggucuucuucaccuucgugcugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgucggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacgguggccuggcgcaccgccacccugauccucgcgggggucagccugcugccggugugccaguccagcuccaugcggaagaccgacuggcuccccaugacgguggccgccaugggcgugccgccccucccgcuguucaucuucagccucaaggacacccugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugacgguggagaaggccgcggacgugaccugggaggaggaggccgagcagaccggcgucagccacaaccugaugaucaccguggacgacgacgggaccaugcgcaucaaggacgacgagacggagaacauccucaccgugcugcugaagaccgcccuccugaucgucuccggcaucuucccguacagcauccccgccacccugcucguguggcacacguggcagaagcagacccagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacacgauguggcacgucacccggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcacguuccagaccaccaccggggagaucggcgcgaucgcccuggacuucaagcccgggacgagcggcagccccaucaucaaccgcgagggcaaggucguggggcuguacggcaacgggguggucaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggccaucgugcgggaggcgaucaagcgccggcuccgcacccugauccuggcccccacccgggucguggccgccgagauggaggaggcccucaaggggcugcccauccgcuaccagacgaccgcgaccaaguccgagcacaccggccgggagaucguggaccugaugugccacgccacguucaccaugcgccuccugagccccguccgggugccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggucugguucgugcccagcaucaaggcgggcaacgacaucgccaacugccuccggaagaacgggaagaaggugauccagcugucccgcaagaccuucgacaccgaguaccagaagaccaagcugaacgacugggacuucgucgugacgaccgacaucagcgagaugggcgccaacuucaaggccgaccgggugaucgacccgcgccggugccucaagcccgucauccugaccgacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacuccgacccgcuggcccucaaggaguucaaggacuucgccgcgggccgcaagagcaucgcccuggaccuggucaccgagaucgggcgggugcccacccaccucgcccaccgcacgcggaacgcccuggacaaccuggugaugcuccacaccuccgagcacggcgggaaggccuaccgccacgcggucgaggagcugcccgagaccauggagacccugcuccugcugggccucaugauccugcugaccggcggggccaugcuguuccugaucagcgggaaggggaucggcaagaccagcaucgggcugaucugcgugaucgccuccagcggcaugcucuggauggccgagaucccgcugcaguggaucgccuccgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagacgaccaagcgcgaccugggcaugagcaaggagccgggggucgugucccccaccagcuaccuggacguggaccuccaccccgccuccgccuggacccuguacgccgucgcgacgaccgugaucacccccaugcugcggcacaccaucgagaacagcacggccaacgugucccucgccgccaucgccaaccaggcggucgugcugaugggccuggacaagggguggccgaucagcaagauggaccucggcgugccccugcuggcccucgggugcuacucccaggucaacccccugacccugaccgccgccgugcuccugcugaucacccacuacgccaucaucggccccggccuccaggcgaaggccacgcgcgaggcccagaagcggaccgccgccgggaucaugaagaacccgaccguggacggcaucaugaccaucgaccuggaccccgucaucuacgacagcaaguucgagaagcagcugggccaggugaugcuccuggugcugugcgcgguccagcuccugcugaugcgcacguccugggcccucugcgaggcccugacccuggccaccggccccaucaccacgcucugggagggcagccccgggaaguucuggaacaccaccaucgcgguguccauggccaacaucuuccggggcagcuaccuggccggggccggccuggccuucuccaucaugaaguccguggggaccggcaagcgcggcaccgggucccagggcgagacgcucggggagaaguggaagaagaagcugaaccagcugagccggaaggaguucgaccucuacaagaaguccggcaucaccgaggucgaccgcaccgaggcgaaggaggggcugaagcggggcgagaucacccaccacgccgugucccgcggcagcgccaagcugcagugguucguggagcggaacauggucaucccggaggggcgcgugaucgaccucggcugcgggcggggcgggugguccuacuacugcgccggccugaagaaggugacggagguccgcggcuacaccaagggcgggcccgggcacgaggagcccgugcccaugagcaccuacggcuggaacaucgugaagcugauguccgggaaggacgucuucuaccucccgcccgagaagugcgacacccugcugugcgacaucggcgagagcucccccagccccacgguggaggagucccggaccauccgcgugcugaagauggucgagccguggcucaagaacaaccaguucugcaucaaggugcugaaccccuacaugcccaccgugaucgagcaccuggagcgccuccagcggaagcacggcgggaugcugguccgcaacccccugagccggaacuccacccacgagauguacuggaucagcaacggcacggggaacaucguggccuccgugaacauggucagccgccuccugcugaaccgguucaccaugacccaccgccggccgaccaucgagaaggacguggaccucggcgcgggcacgcgccacgugaacgccgagcccgagacccccaacauggacgucaucggggagcggaucaagcgcaucaaggaggagcacgacuccaccuggcacuacgacgacgagaacccguacaagaccugggccuaccacggcagcuacgaggugaaggccacgggguccgccagcuccaugaucaacggcgucgugaagcugcugaccaagcccugggacgugguccccauggugacccagauggcgaugaccgacacgacccccuucgggcagcagcggguguucaaggagaaggucgacacccgcaccccgcggagcaugcccggcacgcgccgggugaugggcaucaccgccgaguggcucuggcgcacccuggggcggaacaagaagccccgccugugcacccgggaggaguucacgaagaaggugcgcaccaacgccgccaugggcgcggucuucaccgaggagaaccagugggacagcgccaaggccgccguggaggacgaggacuucuggaagcucguggaccgcgagcgggagcugcacaagcuggggaagugcggcuccugcgucuacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacaccgcggggugggacacgcggaucaccgaggacgaccugcacaacgaggagaagaucacccagcagauggacccggagcaccgccagcucgccaacgccaucuucaagcugaccuaccagaacaagguggucaaggugcagcggcccacccccacgggcaccgugauggacaucaucucccgcaaggaccagcggggcagcgggcaggucggcaccuacgggcugaacaccuucacgaacauggaggcccagcucauccgccagauggagggcgagggggugcuguccaaggccgaccuggagaacccccaccucccggagaagaagaucacccaguggcuggagaccaagggcguggagcggcugaagcgcauggcgaucagcggcgacgacugcgucgugaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcugguggugcccugccgcccccaggacgagcugaucggccgggcccgcaucucccagggggcgggcuggagccuccgggagaccgccugccugggcaaggccuacgcccagauguggucccugauguacuuccaccgccgcgaccuccggcuggcgagcaacgccaucugcuccgccguccccgugcacugggugccgacgagccgcaccaccugguccauccacgcccaccaccaguggaugaccacggaggacaugcugaccgucuggaaccggguguggaucgaggacaaccccuggauggaggacaagacccccgugaccacgugggagaacguccccuaccucgggaagcgcgaggaccaguggugcggcagccugaucgggcugaccagccgggccaccugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 9876 - RNA, 9873 nt, Artificial Sequence
  derived and/or modified CDS sequence (opt1) from DENV-3__FJ850080__SS-prME
accagccucugccucaugaugauccugcccgccgcccuggcguuccaccucaccagccgggacggcgagccccggaugaucguggggaagaacgagcggggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggacgagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcaggucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgcgucccgggccuggaacgugugggagguggaggacuacggguucggcgucuucaccaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgcgauccuguucgaggaggugaugcgggggaaguucggcaagaagcacaugaucgccgggguguucuucauguucguccugcuccuguccggccagaucaccuggcgcgacauggcccacacccugaucaugaucggcagcaacgccuccgaccggauggggaugggcgugaccuaccucgcccugaucgcgacguucaagauccagcccuuccuggcccucggguucuuccugcgcaagcugaccagccgggagaaccuccugcugggcgugggccucgccauggccaccacccugcagcugcccgaggacaucgagcagauggcgaacgggaucgcccucggccugauggcccugaagcucaucacgcaguucgagaccuaccagcuguggaccgcccugaucagccugaccugcuccaacacgauguucacccugaccgucgccuggcgcaccgcgacgcugauccucgccggggugagccugcugccggucugccaguccagcuccaugcggaagaccgacuggcuccccauggccguggccgccaugggcgugccgccccucccgcuguucaucuucagccucaaggacacccugaagcgccgcuccuggccccugaacgagggggucauggcggugggccucgugagcauccuggccuccagccugcuccggaacgacguccccauggccggcccccugguggccgggggccugcucaucgccugcuacgugaucaccgggacguccgcggaccugaccgucgagaaggccgccgacaucaccugggaggaggaggccgagcagaccggcgugagccacaaccugaugaucacgguggacgacgacgggaccaugcgcaucaaggacgacgagaccgagaacauccucaccguccugcugaagaccgcccuccugaucguguccggcguguucccguacagcauccccgcgacgcugcucgucuggcacaccuggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacccggggcgccguccucaccuacaacgggaagcgccuggagcccaacugggccuccgugaagaaggaccugaucagcuacggcgggggcuggcggcucuccgcgcaguggcagaagggggaggaggugcaggucaucgccguggagcccggcaagaaccccaagaacuuccagacgaugcccggcaccuuccagaccaccacgggggagaucggcgccaucgcccuggacuucaagcccgggaccagcggcagccccaucaucaaccgcgagggcaagguggucgggcuguacggcaacgggguggugaccaagaacggcggguacgucuccggcaucgcccagaccaacgcggagccggacggccccacgcccgagcuggaggaggagauguucaagaagcggaaccucaccaucauggaccugcaccccgggagcggcaagacccgcaaguaccugccggccaucgugcgggaggccaucaagcgccggcuccgcacccugauccuggcccccacgcggguggucgccgcggagauggaggaggcccucaaggggcugcccauccgcuaccagaccaccgccaccaaguccgagcacacgggccgggagaucguggaccugaugugccacgccaccuucaccaugcgccuccugagccccgugcgggucccgaacuacaaccugaucaucauggacgaggcccacuucaccgaccccgcguccaucgccgcccgcggguacaucagcacgcgggugggcaugggcgaggccgcggccaucuucaugaccgccacgccgcccgggaccgccgacgccuucccgcaguccaacgcgcccauccaggacgaggagcgcgacauccccgagcgcagcuggaacuccggcaacgaguggaucacggacuucgccgggaagaccgugugguucguccccagcaucaaggccggcaacgacaucgccaacugccuccggaagaacgggaagaaggugauccagcugucccgcaagaccuucgacaccgaguaccagaagacgaagcugaacgacugggacuucguggucaccaccgacaucagcgagaugggcgccaacuucaaggcggaccgggugaucgacccgcgccggugccucaagcccgugauccugaccgacggccccgagcgcgucauccuggccgggcccaugccggugacggccgccuccgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagucccggaagaccuucgucgagcugaugcgccgcggggaccuccccguguggcuggcccacaaggucgccagcgagggcaucaaguacacggaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcgcucaaggaguucaaggacuucgccgccggccgcaagagcaucgcccuggaccuggugaccgagaucgggcggguccccucccaccucgcccaccgcacgcggaacgcgcuggacaaccuggugaugcuccacaccagcgagcacggcgggcgcgccuaccggcacgccguggaggagcugcccgagaccauggagacccugcuccugcugggccucaugauccugcugaccggcggggccaugcuguuccugaucagcgggaaggggaucggcaagaccuccaucgggcugaucugcgucaucgccagcuccggcaugcucuggauggcggagaucccgcugcaguggaucgccagcgccaucgugcuggaguucuucaugauggugcuccugauccccgagcccgagaagcagcgcacgccccaggacaaccagcuggccuacgucgugaucgggauccucacccuggccgcgaucaucgccgccaacgagaugggccugcucgagacgaccaagcgggaccugggcauguccaaggagccggggguggucagccccaccuccuaccuggacguggaccuccaccccgccagcgcguggacccuguacgccguggccacgaccgucaucacccccaugcugcgccacaccaucgagaacuccacggccaacgugagccucgccgcgaucgccaaccaggccgugguccugaugggccuggacaagggguggccgaucuccaagauggaccucggcgugccccugcuggcccucgggugcuacagccaggugaacccccugacccugaccgccgcgguccuccugcugaucacccacuacgccaucaucggccccggccuccaggccaaggccacgcgggaggcccagaagcgcaccgcggccgggaucaugaagaacccgaccguggacggcaucaugaccaucgaccuggaccccgugaucuacgacuccaaguucgagaagcagcuggggcaggucaugcuccuggugcugugcgccgugcagcuccugcugaugcggacgagcugggcccucugcgaggcgcugacccuggccaccggccccaucaccacgcucugggagggcucccccgggaaguucuggaacaccaccaucgccgucagcauggccaacaucuuccgcggcuccuaccuggccggggcgggccuggccuucagcaucaugaaguccguggggaccggcaagcggggcacggggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagaccacgcaccacgccgucagccggggcuccgccaagcugcagugguucguggagcgcaacauggugaucccggaggggcgggucaucgaccucggcugcgggcgcggcggguggagcuacuacugcgcgggccugaagaaggugaccgaggugcggggcuacaccaagggcggccccgggcacgaggagcccguccccauguccaccuacggcuggaacaucaucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaagauccugaaccccuacaugcccaccgugaucgagcaccuggagcggcuccagcgcaagcacggcgggaugcugguccggaacccccugucccgcaacagcacgcacgagauguacuggaucuccaacggcaccgggaacaucguggccagcgugaacauggucucccggcuccugcugaaccgcuucaccaugacccaccggcgcccgacgaucgagaaggacguggaccucggcgccggcacccggcacgugaacgccgagcccgagacccccaacauggacgucaucggggagcgcaucaagcggaucaaggaggagcacaacagcaccuggcacuacgacgacgagaacccguacaagacgugggccuaccacggcuccuacgaggugaaggcgaccgggagcgccuccagcaugaucaacggcguggucaagcugcugaccaagcccugggacgugguccccauggugacccagauggccaugacggacaccacccccuucgggcagcagcgcguguucaaggagaaggucgacacccggacgccgcgcagcaugcccggcacccggcgcgugaugggcaucaccgccgaguggcucuggcggacccuggggcgcaacaagaagccccggcugugcacgcgcgaggaguucaccaagaaggugcgcaccaacgcggccaugggcgccgucuucaccgaggagaaccagugggacuccgccaaggccgcgguggaggacgaggacuucuggaagcucguggaccgggagcgcgagcugcacaagcuggggaagugcggcagcugcgucuacaacaugauggggaagcgggagaagaagcucggcgaguucggcaaggccaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgcgauguacgccgacgacacggccgggugggacacccgcaucaccgaggacgaccugcacaacgaggagaagaucacccagcagauggacccggagcaccggcagcucgccaacgccaucuucaagcugacguaccagaacaagguggucaaggugcagcgccccacccccaccggcaccgugauggacaucaucagccggaaggaccagcgcggcuccgggcaggucggcaccuacgggcugaacacguucaccaacauggaggcgcagcucauccggcagauggagggcgagggggugcugagcaaggccgaccuggagaacccccaccucccggagaagaagaucacccaguggcuggagaccaagggcguggagcgccugaagcggauggccaucuccggcgacgacugcgucgugaagcccaucgacgaccgcuucgccaacgcccuccuggcgcugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcccggaucagccagggggccggcuggucccuccgcgagacggccugccugggcaaggcguacgcccagauguggagccugauguacuuccaccgccgggaccuccgccuggccuccaacgccaucugcagcgccguccccgugcacugggugccgaccucccggaccaccuggagcauccacgcgcaccaccaguggaugacgaccgaggacaugcugaccgucuggaaccgcguguggaucgaggacaaccccuggauggaggacaagacccccgugacgaccugggaggacguccccuaccucgggaagcgggaggaccaguggugcggcagccugaucgggcugaccucccgcgccaccugggcccagaacaucccgacggccauccagcagguccggagccucaucggcaacgaggaguuccuggacuacaugcccuccaugaagcgcuuccggaaggaggaggagagcgagggggccaucugguga

SEQ ID NO: 9877 - RNA, 9873 nt, Artificial Sequence
  derived and/or modified CDS sequence (opt1) from DENV-3__FJ850083__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcagcacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagcgcgagguguccgagacccagcacgggaccauccucaucaagguggaguacaagggcgaggacgcgccgugcaagauccccuucagcaccgaggacgggcagggcaaggcccacaacggccggcugaucacggccaaccccgucgugaccaagaaggacgagcccgugaacaucgaggccgagccgcccuucggggagagcaacaucgucaucggcaucggggacaacgcgcugaagaucaacugguacaagaagggcuccagcaucgggaagauguucgaggccaccgcccgcggcgcccggcgcauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaccaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccggagcaccacccgcauggagaaccugcuguggaagcagaucgccaacgagcucaacuacauccugugggagaacaacaucaagcugaccgugguggucggggacaucaucggcgugcucgagcagggcaagcggacgcugacgccccagccgauggagcugaaguacuccuggaagaccugggggaaggccaagaucgugaccgccgagacgcagaacagcuccuucaucaucgacggccccaacacccccgagugccccagcgcgucccgcgccuggaacgucugggagguggaggacuacggguucggcguguucaccaccaacaucuggcucaagcugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggucaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgcgauccuguucgaggaggucaugcgcgggaaguucggcaagaagcacaugaucgccgggguguucuucaccuucgugcugcuccuguccggccagaucaccuggcgggacauggcccacacgcugaucaugaucggcagcaacgccuccgaccgcauggggaugggcgucaccuaccucgcccugaucgcgaccuucaagauccagcccuuccuggcccucggguucuuccugcggaagcugaccagccgcgagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccauguucacccugacgguggccuggcggaccgcgacccugauccucgccggggucagccugcugccggugugccaguccagcuccaugcgcaagaccgacuggcuccccauggccgucgccgccaugggcgugccgccccucccgcuguucaucuucagccucaaggacacgcugaagcgccgguccuggccccugaacgagggggugauggcggucggccucgugagcauccuggccuccagccugcuccgcaacgacgugcccauggccggcccccuggucgccgggggccugcucaucgccugcuacgugaucaccgggaccuccgcggaccugaccguggagaaggccgccgacaucacgugggaggaggaggccgagcagaccggcgucagccacaaccugaugaucaccguggacgacgacgggaccaugcggaucaaggacgacgagaccgagaacauccucacggugcugcugaagaccgcccuccugaucgucuccggcguguucccguacagcauccccgcgacccugcucguguggcacaccuggcagaagcagacgcagcgcuccggcguccugugggacgugcccagcccgcccgagacccagaaggccgagcuggaggaggggguguaccggaucaagcagcagggcaucuucgggaagacccaggucggcgugggggugcagaaggagggcgucuuccacaccauguggcacgugacgcgcggcgccgugcucaccuacaacgggaagcggcuggagcccaacugggccuccgucaagaaggaccugaucagcuacggcgggggcuggcgccucuccgcgcaguggcagaagggggaggagguccaggugaucgccgucgagcccggcaagaaccccaagaacuuccagaccaugcccggcaccuuccagacgaccaccggggagaucggcgccaucgcccuggacuucaagcccgggaccagcggcagccccaucaucaaccgggagggcaaggugguggggcuguacggcaacggggucgugacgaagaacggcggguacguguccggcaucgcccagaccaacgcggagccggacggccccacccccgagcuggaggaggagauguucaagaagcgcaaccucaccaucauggaccugcaccccgggagcggcaagacgcggaaguaccugccggccaucguccgcgaggccaucaagcggcgccuccggacccugauccuggcccccacccgcgugguggccgcggagauggaggaggcccucaaggggcugcccauccgguaccagaccacggccaccaaguccgagcacaccggccgcgagaucgucgaccugaugugccacgccaccuucacgaugcggcuccugagccccgugcgcgugccgaacuacaaccugaucaucauggacgaggcccacuucaccgaccccgcguccaucgccgcccggggguacaucagcacccgcgucggcaugggcgaggccgcggccaucuucaugaccgccacgccgcccgggaccgccgacgccuucccgcaguccaacgcgcccauccaggacgaggagcgcgacauccccgagcggagcuggaacuccggcaacgaguggaucaccgacuucgccgggaagaccgugugguucgugcccagcaucaaggccggcaacgacaucgccaacugccuccgcaagaacgggaagaaggucauccagcugucccggaagacguucgacaccgaguaccagaagaccaagcugaacgacugggacuucguggugaccacggacaucagcgagaugggcgccaacuucaaggcggaccgcgucaucgacccgcggcgcugccucaagcccgugauccugaccgacggccccgagcgggugauccuggccgggcccaugccggucaccgccgccuccgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgcgagaaguccgcggccaucgacggcgaguaccggcugaagggcgagucccgcaagaccuucguggagcugaugcggcgcggggaccuccccgucuggcuggcccacaagguggccagcgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccgcacguacuccgacccgcuggcgcucaaggaguucaaggacuucgccgccggccgcaagagcaucgcccuggaccuggugaccgagaucgggcgcgugcccucccaccucgcccaccggacccgcaacgcgcuggacaaccuggucaugcuccacaccagcgagcacggcgggcgggccuaccgccacgccguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucguccuggaguucuucaugauggugcuccugauccccgagcccgagaagcagcggacgccccaggacaaccagcuggccuacguggucaucgggauccucacccuggccgcgaucaucgccgccaacgagaugggccugcucgagaccaccaagcgcgaccugggcauguccaaggagccggggguggugagccccacguccuaccuggacgucgaccuccaccccgccagcgcguggacccuguacgccguggccaccaccgugaucacgcccaugcugcggcacaccaucgagaacuccaccgccaacgucagccucgccgcgaucgccaaccaggccguggugcugaugggccuggacaagggguggccgaucuccaagauggaccucggcgucccccugcuggcccucgggugcuacagccaggugaacccccugacccugacggccgcggugcuccugcugaucacccacuacgccaucaucggccccggccuccaggccaaggccacccgcgaggcccagaagcggaccgcggccgggaucaugaagaacccgacggucgacggcaucaugaccaucgaccuggaccccgugaucuacgacuccaaguucgagaagcagcugggccaggugaugcuccugguccugugcgccgugcagcuccugcugaugcgcaccagcugggcccucugcgaggcgcugacccuggccacgggccccaucaccacccucugggagggcucccccgggaaguucuggaacaccacgaucgccgugagcauggccaacaucuuccggggcuccuaccuggccggggcgggccuggccuucagcaucaugaaguccgucgggaccggcaagcgcggcaccgggagccagggcgagacccucggggagaaguggaagaagaagcugaaccagcugagccggaaggaguucgaccucuacaagaaguccggcaucaccgagguggaccgcacggaggccaaggaggggcugaagcggggcgagaccacccaccacgccgugagccgcggcuccgccaagcugcagugguucgucgagcggaacauggugaucccggaggggcgcgugaucgaccucggcugcgggcggggcggguggagcuacuacugcgcgggccugaagaaggucaccgaggugcgcggcuacacgaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccaccguggaggagagccgcacgauccggguccugaagaugguggagccguggcucaagaacaaccaguucugcaucaagauccugaaccccuacaugcccaccgugaucgagcaccuggagcgccuccagcggaagcacggcgggaugcugguccgcaacccccugucccggaacagcacccacgagauguacuggaucuccaacggcaccgggaacaucguggccagcgugaacauggucucccgccuccugcugaaccgguucacgaugacccaccgccggccgaccaucgagaaggacguggaccucggcgccggcacccgccacgugaacgccgagcccgagacgcccaacauggacgucaucggggagcggaucaagcgcaucaaggaggagcacaacagcaccuggcacuacgacgacgagaacccguacaagaccugggccuaccacggcuccuacgaggugaaggcgaccgggagcgccuccagcaugaucaacggcguggucaagcugcugacgaagcccugggacgugguccccauggugacccagauggccaugaccgacaccacgcccuucgggcagcagcggguguucaaggagaaggucgacacccgcaccccgcggagcaugcccggcacccgccgggugaugggcaucacggccgaguggcucuggcgcacccuggggcggaacaagaagccccgccugugcacccgcgaggaguucaccaagaaggugcggacgaacgcggccaugggcgccgucuucaccgaggagaaccagugggacuccgccaaggccgcgguggaggacgaggacuucuggaagcucguggaccgcgagcgggagcugcacaagcuggggaagugcggcagcugcgucuacaacaugauggggaagcgcgagaagaagcucggcgaguucggcaaggccaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgcgauguacgccgacgacaccgccgggugggacacccggaucacggaggacgaccugcacaacgaggagaagaucacccagcagauggacccggagcaccgccagcucgccaacgccaucuucaagcugaccuaccagaacaagguggucaaggugcagcggcccacccccaccggcacggugauggacaucaucagccgcaaggaccagcggggcuccgggcaggucggcaccuacgggcugaacaccuucaccaacauggaggcgcagcucauccgccagauggagggcgagggggugcugagcaaggccgaccuggagaacccccaccucccggagaagaagaucacgcaguggcuggagaccaagggcguggagcggcugaagcgcauggccaucuccggcgacgacugcgucgugaagcccaucgacgaccgguucgccaacgcccuccuggcgcugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggccggcuggucccuccgcgagaccgccugccugggcaaggcguacgcccagauguggagccugauguacuuccaccggcgcgaccuccggcuggccuccaacgccaucugcagcgccguccccgugcacugggugccgaccucccgcacgaccuggagcauccacgcgcaccaccaguggaugaccaccgaggacaugcugacggucuggaaccggguguggaucgaggacaaccccuggauggaggacaagacccccgugaccaccugggaggacguccccuaccucgggaagcgcgaggaccaguggugcggcagccugaucgggcugacgucccgggccaccugggcccagaacaucccgaccgccauccagcagguccgcagccucaucggcaacgaggaguuccuggacuacaugcccuccaugaagcgguuccgcaaggaggaggagagcgagggggccaucugguga

SEQ ID NO: 9878 - RNA, 9873 nt, Artificial Sequence
  derived and/or modified CDS sequence (opt1) from DENV-3__FJ850086__SS-prME
accagccucugccucaugaugauccugcccgcggcccuggcguuccaccucaccagccgggacggcgagccccggaugaucguggggaagaacgagcggggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcgccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgccccgugcaagauccccuucagcaccgaggacgggcagggcaaggcccacaacggccgccugaucaccgccaaccccgucgugacgaagaaggacgagcccgugaacaucgaggcggagccgcccuucggggagagcaacaucgucaucggcaucggggacaacgcccugaagaucaacugguacaagaagggcuccagcaucgggaagauguucgaggccaccgcccggggcgcccgccggauggcgauccugggcgacaccgccugggacuucggguccgugggcggggugcucaacagccugggcaagaccguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgcgguggugcaggccgacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgcgggcgccugggagaacggggucugcggcauccgcagcacgacccggauggagaaccugcuguggaagcaggucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgcggagacccagaacagcuccuucaucaucgacggccccaacacgcccgagugccccagcgccucccgggccuggaacgugugggagguggaggacuacggguucggcgucuucaccaccaacaucuggcucaagcugcgcgagguguacacccagcugugcgaccaccggcucaugagcgccgccgugaaggacgagcgcgcgguccacgccgacaugggcuacuggaucgagagccagaagaacggguccuggaagcuggagaaggccagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgcgggcagcgggaagguggacaacuucacgaugggcguccugugccucgccauccuguucgaggaggugaugcgggggaaguucggcaagaagcacaugaucgccgggguguucuucauguucguccugcuccuguccggccagaucaccuggcgcgacauggcccacacccugaucaugaucggcagcaacgccuccgaccggauggggaugggcgugaccuaccucgcgcugaucgccacguucaagauccagcccuuccuggcccucggguucuuccugcgcaagcugaccagccgggagaaccuccugcugggcgugggccucgccauggcgaccacccugcagcugcccgaggacaucgagcagauggccaacgggaucgcccucggccugauggcccugaagcucaucacgcaguucgagaccuaccagcuguggaccgcccugaucagccugaccugcuccaacacgauguucacccugaccgucgcguggcgcaccgccacgcugauccucgccggggugagccugcugccggucugccaguccagcuccaugcggaagaccgacuggcuccccauggccguggccgcgaugggcgugccgccccucccgcuguucaucuucagccucaaggacacccugaagcgccgcuccuggccccugaacgagggggucauggccgugggccucgugagcauccuggccuccagccugcuccggaacgacguccccauggccggcccccugguggccgggggccugcucaucgcgugcuacgugaucaccgggacguccgccgaccugaccgucgagaaggccgccgacaucaccugggaggaggaggccgagcagaccggcgugagccacaaccugaugaucacgguggacgacgacgggaccaugcgcaucaaggacgacgagaccgagaacauccucaccguccugcugaagaccgcgcuccugaucguguccggcguguucccguacagcauccccgccacgcugcucgucuggcacaccuggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacccggggcgccguccucaccuacaacgggaagcgccuggagcccaacugggcguccgugaagaaggaccugaucagcuacggcgggggcuggcggcucuccgcccaguggcagaagggggaggaggugcaggucaucgccguggagcccggcaagaaccccaagaacuuccagacgaugcccggcaccuuccagaccaccacgggggagaucggcgccaucgcccuggacuucaagcccgggaccagcggcagccccaucaucaaccgcgagggcaagguggucgggcuguacggcaacgggguggugaccaagaacggcggguacgucuccggcaucgcgcagaccaacgccgagccggacggccccacgcccgagcuggaggaggagauguucaagaagcggaaccucaccaucauggaccugcaccccgggagcggcaagacccgcaaguaccugccggccaucgugcgggaggccaucaagcgccggcuccgcacccugauccuggcccccacgcggguggucgcggccgagauggaggaggcccucaaggggcugcccauccgcuaccagaccaccgccaccaaguccgagcacacgggccgggagaucguggaccugaugugccacgccaccuucaccaugcgccuccugagccccgugcgggucccgaacuacaaccugaucaucauggacgaggcgcacuucaccgaccccgccuccaucgccgcccgcggguacaucagcacgcgggugggcaugggcgaggcggccgccaucuucaugaccgccacgccgcccgggaccgccgacgcguucccgcaguccaacgcccccauccaggacgaggagcgcgacauccccgagcgcagcuggaacuccggcaacgaguggaucacggacuucgccgggaagaccgugugguucguccccagcaucaaggccggcaacgacaucgccaacugccuccggaagaacgggaagaaggugauccagcugucccgcaagaccuucgacaccgaguaccagaagacgaagcugaacgacugggacuucguggucaccaccgacaucagcgagaugggcgcgaacuucaaggccgaccgggugaucgacccgcgccggugccucaagcccgugauccugaccgacggccccgagcgcgucauccuggccgggcccaugccggugacggccgccuccgcggcccagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcccacaaggucgccagcgagggcaucaaguacacggaccgcaaguggugcuucgacgggcagcggaacaaccagauccuggaggagaacauggacguggagaucuggaccaaggagggcgagaagaagaagcuccgcccccgguggcuggacgcgcgcaccuacuccgacccgcuggcccucaaggaguucaaggacuucgccgccggccgcaagagcaucgcccuggaccuggugaccgagaucgggcggguccccucccaccucgcgcaccgcacgcggaacgcccuggacaaccuggugaugcuccacaccagcgagcacggcgggcgcgccuaccggcacgccguggaggagcugcccgagaccauggagacccugcuccugcugggccucaugauccugcugaccggcggggccaugcuguuccugaucagcgggaaggggaucggcaagaccuccaucgggcugaucugcgucaucgcgagcuccggcaugcucuggauggccgagaucccgcugcaguggaucgccagcgccaucgugcuggaguucuucaugauggugcuccugauccccgagcccgagaagcagcgcacgccccaggacaaccagcuggccuacgucgugaucgggauccucacccuggcggccaucaucgccgccaacgagaugggccugcucgagacgaccaagcgggaccugggcauguccaaggagccggggguggucagccccaccuccuaccuggacguggaccuccaccccgcgagcgccuggacccuguacgccguggccacgaccgucaucacccccaugcugcgccacaccaucgagaacuccacggccaacgugagccucgcggccaucgccaaccaggccgugguccugaugggccuggacaagggguggccgaucuccaagauggaccucggcgugccccugcuggcccucgggugcuacagccaggugaacccccugacccugaccgcggccguccuccugcugaucacccacuacgccaucaucggccccggccuccaggccaaggccacgcgggaggcgcagaagcgcaccgccgccgggaucaugaagaacccgaccguggacggcaucaugaccaucgaccuggaccccgugaucuacgacuccaaguucgagaagcagcuggggcaggucaugcuccuggugcugugcgccgugcagcuccugcugaugcggacgagcugggcgcucugcgaggcccugacccuggccaccggccccaucaccacgcucugggagggcucccccgggaaguucuggaacaccaccaucgccgucagcauggccaacaucuuccgcggcuccuaccuggcgggggccggccuggccuucagcaucaugaaguccguggggaccggcaagcggggcacggggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagaccacgcaccacgccgucagccggggcuccgcgaagcugcagugguucguggagcgcaacauggugaucccggaggggcgggucaucgaccucggcugcgggcgcggcggguggagcuacuacugcgccggccugaagaaggugaccgaggugcggggcuacaccaagggcggccccgggcacgaggagcccguccccauguccaccuacggcuggaacaucaucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaagauccugaaccccuacaugcccaccgugaucgagcaccuggagcggcuccagcgcaagcacggcgggaugcugguccggaacccccugucccgcaacagcacgcacgagauguacuggaucuccaacggcaccgggaacaucguggccagcgugaacauggucucccggcuccugcugaaccgcuucaccaugacccaccggcgcccgacgaucgagaaggacguggaccucggcgccggcacccggcacgugaacgccgagcccgagacccccaacauggacgucaucggggagcgcaucaagcggaucaaggaggagcacaacagcaccuggcacuacgacgacgagaacccguacaagacgugggcguaccacggcuccuacgaggugaaggccaccgggagcgccuccagcaugaucaacggcguggucaagcugcugaccaagcccugggacgugguccccauggugacccagauggccaugacggacaccacccccuucgggcagcagcgcguguucaaggagaaggucgacacccggacgccgcgcagcaugcccggcacccggcgcgugaugggcaucaccgcggaguggcucuggcggacccuggggcgcaacaagaagccccggcugugcacgcgcgaggaguucaccaagaaggugcgcaccaacgccgccaugggcgccgucuucaccgaggagaaccagugggacuccgccaaggcggccguggaggacgaggacuucuggaagcucguggaccgggagcgcgagcugcacaagcuggggaagugcggcagcugcgucuacaacaugauggggaagcgggagaagaagcucggcgaguucggcaaggccaaggggucccgcgccaucugguacauguggcugggcgcccgguaccuggaguucgaggcgcucggguuccugaacgaggaccacugguucagccgcgagaacuccuacagcggcguggagggggagggccugcacaagcucggcuacauccugcgggacaucuccaagauccccgggggcgccauguacgccgacgacacggccgggugggacacccgcaucaccgaggacgaccugcacaacgaggagaagaucacccagcagauggacccggagcaccggcagcucgccaacgcgaucuucaagcugacguaccagaacaagguggucaaggugcagcgccccacccccaccggcaccgugauggacaucaucagccggaaggaccagcgcggcuccgggcaggucggcaccuacgggcugaacacguucaccaacauggaggcccagcucauccggcagauggagggcgagggggugcugagcaaggccgaccuggagaacccccaccucccggagaagaagaucacccaguggcuggagaccaagggcguggagcgccugaagcggauggccaucuccggcgacgacugcgucgugaagcccaucgacgaccgcuucgccaacgcgcuccuggcccugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcccggaucagccagggggccggcuggucccuccgcgagacggcgugccugggcaaggccuacgcccagauguggagccugauguacuuccaccgccgggaccuccgccuggccuccaacgccaucugcagcgcgguccccgugcacugggugccgaccucccggaccaccuggagcauccacgcccaccaccaguggaugacgaccgaggacaugcugaccgucuggaaccgcguguggaucgaggacaaccccuggauggaggacaagacccccgugacgaccugggaggacguccccuaccucgggaagcgggaggaccaguggugcggcagccugaucgggcugaccucccgcgccaccugggcccagaacaucccgacggccauccagcagguccggagccucaucggcaacgaggaguuccuggacuacaugcccuccaugaagcgcuuccggaaggaggaggagagcgagggggcgaucugguga

SEQ ID NO: 9879 - RNA, 9873 nt, Artificial Sequence
  derived and/or modified CDS sequence (opt1) from DENV-3__FJ850089__SS-prME
accagccugugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcagcacgagaaccucaaguacaccgugaucaucacgguccacaccggggaccagcaccaggugggcaacgagacccagggggucaccgccgagaucacgccccaggccagcaccaccgaggugauccugcccgaguacggcacccuggggcucgagugcuccccgcgcaccggccuggacuucaacgagaugauccugcucacgaugaagaacaaggcguggauggugcaccggcagugguucuucgaccugccccugcccuggaccagcggcgccaccaccgagacgcccaccuggaaccgcaaggagcuccuggucaccuucaagaacgcccacgccaagaagcaggagguggugguccuggggucccaggagggcgccaugcacaccgcgcucacgggggccaccgagauccagaacagcggcgggaccuccaucuucgccggccaccugaagugccggcugaagauggacaagcucgagcugaagggcaugagcuacgccaugugcaccaacacguucgugcugaagaaggagguguccgagacccagcacgggaccauccucaucaaggucgaguacaagggcgaggacgccccgugcaagauccccuucagcaccgaggacgggcagggcaaggcgcacaacggccgccugaucacggccaaccccguggugaccaagaaggacgagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaaggugggcaucggggugcuccugaccuggaucggccugaacagcaagaacaccuccaugagcuucuccugcaucgccaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgccucccgggcguggaacgugugggaggucgaggacuacggguucggcguguucaccaccaacaucuggcucaagcugcgcgagguguacacccagcugugcgaccaccggcucaugagcgccgccgucaaggacgagcgcgccgugcacgccgacaugggcuacuggaucgagagccagaagaacggguccuggaagcuggagaaggcgagccugaucgaggugaagaccugcacguggccgaagucccacacccucuggagcaacggcguccuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgcgggggucuucuucaccuucgugcugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgucggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccauguucacccugaccguggccuggcgcacggccacccugauccucgcgggggucagccugcugccggugugccaguccagcuccaugcggaagaccgacuggcuccccauggccguggccgccaugggcgugccgccccucccgcuguucaucuucagccucaaggacacccugaagcgccgcuccuggccccugaacgagggggugauggccgugggccucgucagcauccuggcguccagccugcuccggaacgacgugcccauggccggcccccugguggccgggggccugcucaucgccugcuacgucaucacggggaccuccgccgaccugaccguggagaaggcggccgacaucaccugggaggaggaggccgagcagacgggcgugagccacaaccugaugaucaccgucgacgacgacgggaccaugcgcaucaaggacgacgagaccgagaacauccucaccgugcugcugaagacggcccuccugaucguguccggcgucuucccguacagcauccccgccacccugcucguguggcacaccuggcagaagcagacccagcgguccggcgugcugugggacguccccagcccgcccgagacgcagaaggcggagcuggaggaggggguguaccgcaucaagcagcagggcaucuucgggaagacccaggugggcgucggggugcagaaggagggcguguuccacaccauguggcacgucacccggggcgccgugcucacguacaacgggaagcgccuggagcccaacugggccuccgugaagaaggaccugaucagcuacggcgggggcuggcggcucuccgcccaguggcagaagggggaggagguccagaucaucgcgguggagcccggcaagaaccccaagaacuuccagaccaugcccggcaccuuccagaccacgaccggggagaucggcgccaucgcccuggacuucaagcccgggaccagcggcagccccaucaucaaccgcgagggcaagguggucgggcuguacggcaacgggguggugaccaagaacggcggguacgucuccggcaucgcccagacgaacgccgagccggacggccccacccccgagcuggaggaggagauguucaagaagcggaaccucaccaucauggaccugcaccccgggagcggcaagacccgcaaguaccugccggcgaucgugcgggaggccaucaagcgccggcuccgcacgcugauccuggcccccacccggguggucgccgccgagauggaggaggcgcucaaggggcugcccauccgcuaccagaccaccgccacgaaguccgagcacaccggccgggagaucguggaccugaugugccacgccaccuucaccaugcgccuccugagccccgugcgggucccgaacuacaaccugaucaucauggacgaggcccacuucacggaccccgccuccaucgcggcccgcggguacaucagcacccgggugggcaugggcgaggccgccgcgaucuucaugaccgccacgccgcccgggacggccgacgccuucccgcaguccaacgcccccauccaggacgaggagcgcgacauccccgagcgcagcuggaacuccggcaacgaguggaucaccgacuucgcggggaagaccgugugguucguccccagcaucaaggccggcaacgacaucgccaacugccuccggaagaacgggaagaaggugauccagcugucccgcaagaccuucgacacggaguaccagaagaccaagcugaacgacugggacuucguggucaccaccgacaucagcgagaugggcgccaacuucaaggccgaccgggugaucgacccgcgccggugccucaagcccgugauccugacggacggccccgagcgcgucauccuggcggggcccaugccggugaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagacguucgucgagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcccucaaggaguucaaggacuucgcggccggccgcaagagcaucgcccuggaccuggugacggagaucgggcggguccccucccaccucgcccaccgcacccggaacgcccuggacaaccuggugaugcuccacaccagcgagcacggcgggcgcgcguaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgcgagcgccaucgugcuggaguucuucaugauggugcuccugauccccgagcccgagaagcagcgcacgccccaggacaaccagcuggccuacgucgugaucgggauccucacgcuggccgccaucaucgcggccaacgagaugggccugcucgagaccaccaagcgggaccugggcauguccaaggagccggggguggucagccccaccuccuaccuggacguggaccuccaccccgccagcgccuggacgcuguacgcgguggccaccaccgucaucacccccaugcugcgccacacgaucgagaacuccaccgccaacgugagccucgccgccaucgcgaaccaggccgugguccugaugggccuggacaagggguggccgaucuccaagauggaccucggcgugccccugcuggcccucgggugcuacagccaggugaacccccugacccugaccgccgccguccuccugcugaucacgcacuacgcgaucaucggccccggccuccaggccaaggccacccgggaggcccagaagcgcaccgccgcggggaucaugaagaacccgaccguggacggcaucaugacgaucgaccuggaccccgugaucuacgacuccaaguucgagaagcagcuggggcaggucaugcuccuggugcugugcgccgugcagcuccugcugaugcggaccagcugggcccucugcgaggcccugacccuggcgaccggccccaucacgacccucugggagggcucccccgggaaguucuggaacaccaccaucgccgucagcauggccaacaucuuccgcggcuccuaccuggccggggccggccuggcguucagcaucaugaaguccguggggacgggcaagcggggcaccgggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagacgacccaccacgccgucagccggggcuccgccaagcugcagugguucguggagcgcaacauggugaucccggaggggcgggucaucgaccucggcugcgggcgcggcggguggagcuacuacugcgccggccugaagaaggugaccgaggugcggggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccgcaccauccgcgugcugaagaugguggagccguggcucaagaacaaccaguucugcaucaagauccugaaccccuacaugcccacggucaucgagcaccuggagcggcuccagcgcaagcacggcgggaugcuggugcggaacccccugucccgcaacagcacccacgagauguacuggaucuccaacggcaccgggaacaucguggcgagcgucaacauggugucccggcuccugcugaaccgcuucaccaugacgcaccggcgcccgaccaucgagaaggacguggaccucggcgccggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggccaccgggagcgcguccagcaugaucaacggcgucgugaagcugcugaccaagcccugggacgucgugcccauggugacgcagauggccaugaccgacaccacccccuucgggcagcagcgcgucuucaaggagaagguggacacgcggaccccgcgcagcaugcccggcacccggcgcgugaugggcaucaccgccgaguggcucuggcggacgcuggggcgcaacaagaagccccggcugugcacccgcgaggaguucaccaagaagguccgcaccaacgccgcgaugggcgccguguucacggaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgcggacgacaccgccgggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcccagcucauccggcagauggagggcgagggggugcugagcaaggcggaccuggagaacccccaccucccggagaagaagaucacccaguggcuggagacgaagggcgucgagcgccugaagcggauggccaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcgcggaucagccagggggccggcuggucccuccgcgagaccgccugccugggcaaggccuacgcgcagauguggagccugauguacuuccaccgccgggaccuccgccuggccuccaacgccaucugcagcgccgugcccgugcacugggucccgaccucccggaccacguggagcauccacgcccaccaccaguggaugaccaccgaggacaugcugaccguguggaaccgcguguggaucgaggacaaccccuggauggaggacaagacgcccgucaccaccugggaggacgugcccuaccucgggaagcgggaggaccaguggugcggcagccugaucgggcugaccucccgcgcgacgugggcccagaacaucccgaccgccauccagcagguccggagccucaucggcaacgaggaguuccuggacuacaugcccuccaugaagcgcuuccggaaggaggaggagagcgagggggccaucugguga

SEQ ID NO: 9880 - RNA, 9873 nt, Artificial Sequence
  derived and/or modified CDS sequence (opt1) from DENV-3__FJ850092__SS-prME
accagccugugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcagcacgagaaccucaaguacaccgugaucaucacgguccacaccggggaccagcaccaggugggcaacgagacccagggggucaccgccgagaucacgccccaggccagcaccaccgaggugauccugcccgaguacggcacccuggggcucgagugcuccccgcgcaccggccuggacuucaacgagaugauccugcucacgaugaagaacaaggcguggauggugcaccggcagugguucuucgaccugccccugcccuggaccagcggcgucaccaccgagacgcccaccuggaaccgcaaggagcuccuggugaccuucaagaacgcccacgccaagaagcaggagguggucgugcuggggucccaggagggcgccaugcacaccgcccucacgggggcgaccgagauccagaacagcggcgggaccuccaucuucgccggccaccugaagugccggcugaagauggacaagcucgagcugaagggcaugagcuacgccaugugcaccaacacguucgugcugaagaaggaggucuccgagacccagcacgggaccauccucaucaagguggaguacaagggcgaggacgccccgugcaagauccccuucagcaccgaggacgggcagggcaaggcccacaacggccgccugaucacggcgaaccccguggucaccaagaaggacgagcccgugaacaucgaggccgagccgcccuucggggagagcaacaucgugaucggcaucggggacaacgcccugaagaucaacugguacaagaagggcuccagcaucgggaagauguucgaggccaccgcgcggggcgcccgccggauggccauccugggcgacaccgccugggacuucggguccgucggcggggugcucaacagccugggcaagauggugcaccagaucuucggguccgccuacacggcgcuguucagcggcgucuccugggugaugaaggugggcaucgggguccuccugaccuggaucggccugaacagcaagaacaccuccaugagcuucuccugcaucgccaucgggaucaucacccucuaccugggcgccguggugcaggccgacauggggugcgucaucaacuggaagggcaaggagcugaagugcggcagcgggaucuucgugacgaacgaggugcacaccuggaccgagcaguacaaguuccaggccgacucccccaagcgccucgcgaccgccaucgccggcgccugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggcgaagaucgugaccgccgagacccagaacagcuccuucaucaucgacggccccaacacgcccgagugccccagcgccucccgggccuggaacgucugggagguggaggacuacggguucggcguguucaccaccaacaucuggcucaagcugcgcgaggucuacacccagcugugcgaccaccggcucaugagcgcggccgugaaggacgagcgcgccgugcacgccgacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggcggggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgccauccuguucgaggaggucaugcgggggaaguucggcaagaagcacaugaucgccgggguguucuucaccuucgugcugcuccuguccggccagaucaccuggcgcgacauggcgcacacccugaucaugaucggcagcaacgccuccgaccggauggggaugggcgucacguaccucgcccugaucgccaccuucaagauccagcccuuccuggcccucggguucuuccugcgcaagcugaccagccgggagaaccuccugcugggcgugggccucgcgauggccaccacgcugcagcugcccgaggacaucgagcagauggccaacgggaucgcccucggccugauggcgcugaagcucaucacccaguucgagaccuaccagcuguggaccgcccugaucagccucacgugcuccaacaccauguucacccugaccgucgccuggcgcacggccacccugauccucgccggggugagccugcugccggugugccaguccagcuccaugcggaagaccgacuggcuccccauggcggucgccgccaugggcgugccgccccucccgcuguucaucuucagccucaaggacacccugaagcgccgcuccuggccccugaacgagggggugauggccgucggccucgugagcauccuggccuccagccugcuccggaacgacgugcccauggcgggcccccuggucgccgggggccugcucaucgccugcuacgugaucacggggaccuccgccgaccugaucguggagaaggccgcggacaucaccugggaggaggaggccgagcagaccggcgucagccacaaccugaugaucacgguggacgacgacgggaccaugcgcaucaaggacgacgagaccgagaacauccucaccgugcugcugaagaccgcccuccugaucgucuccggcguguucccguacagcauccccgccacgcugcucguguggcacaccuggcagaagcagacccagcgguccggcguccugugggacgugcccagcccgcccgagacccagaaggccgagcuggaggaggggguguaccgcaucaagcagcagggcaucuucgggaagacgcaggucggcgugggggugcagaaggagggcgucuuccacaccauguggcacgugacccggggcgcggugcucaccuacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagacgaugcccggcaccuuccagaccaccacgggggagaucggcgcgaucgcccuggacuucaagcccgggaccagcggcagccccaucaucaaccgcgagggcaaggugguggggcuguacggcaacggggucgugaccaagaacggcggguacguguccggcaucgcccagaccaacgccgagccggacggccccacgcccgagcuggaggaggagauguucaagaagcggaaccucaccaucauggaccugcaccccgggagcggcaagacccgcaaguaccugccggccaucguccgggaggcgaucaagcgccggcuccgcacccugauccuggcccccacgcgggugguggccgccgagauggaggaggcccucaaggggcugcccauccgcuaccagaccaccgcgaccaaguccgagcacacgggccgggagaucgucgaccugaugugccacgccaccuucaccaugcgccuccugagccccgugcgggugccgaacuacaaccugaucaucauggacgaggcccacuucaccgaccccgccuccaucgccgcgcgcggguacaucagcacgcgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucacggacuucgccgggaagaccgugugguucgugcccagcaucaaggcgggcaacgacaucgccaacugccuccggaagaacgggaagaaggucauccagcugucccgcaagaccuucgacaccgaguaccagaagacgaagcugaacgacugggacuucguggugaccaccgacaucagcgagaugggcgccaacuucaaggccgaccgggucaucgacccgcgccggugccucaagcccgugauccugaccgacggccccgagcgcgugauccuggccgggcccaugccggucacggcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaagguggccagcgagggcaucaaguacacggaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggacuucgccgcgggccgcaagagcaucgcccuggaccuggugaccgagaucgggcgggugcccucccaccucgcccaccgcacgcggaacgcccuggacaaccuggucaugcuccacaccagcgagcacggcgggcgcgccuaccggcacgcgguggaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagacgaccaagcgggaccugggcauguccaaggagccggggguggugagccccaccuccuaccuggacgucgaccuccaccccgccagcgccuggacccuguacgccguggcgacgaccgugaucacccccaugcugcgccacaccaucgagaacuccacggccaacgucagccucgccgccaucgccaaccaggcgguggugcugaugggccuggacaagggguggccgaucuccaagauggaccucggcgucccccugcuggcccucgggugcuacagccaggugaacccccugacccugaccgccgccgugcuccugcugaucacccacuacgccaucaucggccccggccuccaggcgaaggccacgcgggaggcccagaagcgcaccgccgccgggaucaugaagaacccgaccgucgacggcaucaugaccaucgaccuggaccccgugaucuacgacuccaaguucgagaagcagcugggccaggugaugcuccugguccugugcgcggugcagcuccugcugaugcggacgagcugggcccucugcgaggcccugacccuggccaccggccccaucaccacgcucugggagggcucccccgggaaguucuggaacaccaccaucgcggugagcauggccaacaucuuccgcggcuccuaccuggccggggccggccuggccuucagcaucaugaaguccgucgggaccggcaagcggggcacggggagccagggcgagacccucggggagaaguggaagaagaagcugaaccagcugagccgcaaggaguucgaccucuacaagaaguccggcaucaccgagguggaccggaccgaggcgaaggaggggcugaagcgcggcgagaccacgcaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaagauccugaaccccuacaugcccaccgugaucgagcaccuggagcggcuccagcgcaagcacggcgggaugcugguccggaacccccugucccgcaacagcacgcacgagauguacuggaucuccaacggcaccgggaacaucguggccagcgugaacauggucucccggcuccugcugaaccgcuucaccaugacccaccggcgcccgacgaucgagaaggacguggaccucggcgcgggcacccggcacgugaacgccgagcccgagacccccaacauggacgucaucggggagcgcaucaagcggaucaaggaggagcacaacagcaccuggcacuacgacgacgagaacccguacaagacgugggccuaccacggcuccuacgaggugaaggccaccgggagcgccuccagcaugaucaacggcgucgugaagcugcugaccaagcccugggacgugguccccauggugacccagauggcgaugacggacaccacccccuucgggcagcagcgcguguucaaggagaaggucgacacccggacgccgcgcagcaugcccggcacccggcgcgugaugggcaucaccgccgaguggcucuggcggacccuggggcgcaacaagaagccccggcugugcacgcgcgaggaguucaccaagaaggugcgcaccaacgccgccaugggcgcggucuucaccgaggagaaccagugggacuccgccaaggccgccguggaggacgaggacuucuggaagcucguggaccgggagcgcgagcugcacaagcuggggaagugcggcagcugcgucuacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacacggcggggugggacacccgcaucaccgaggacgaccugcacaacgaggagaagaucacccagcagauggacccggagcaccggcagcucgccaacgccaucuucaagcugacguaccagaacaagguggucaaggugcagcgccccacccccaccggcaccgugauggacaucaucagccggaaggaccagcgcggcuccgggcaggucggcaccuacgggcugaacacguucaccaacauggaggcccagcucauccggcagauggagggcgagggggugcugagcaaggccgaccuggagaacccccaccucccggagaagaagaucacccaguggcuggagaccaagggcguggagcgccugaagcggauggcgaucuccggcgacgacugcgucgugaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcccggaucagccagggggcgggcuggucccuccgcgagacggccugccugggcaaggccuacgcccagauguggagccugauguacuuccaccgccgggaccuccgccuggcguccaacgccaucugcagcgccguccccgugcacugggugccgaccucccggaccaccuggagcauccacgcccaccaccaguggaugacgaccgaggacaugcugaccgucuggaaccgcguguggaucgaggacaaccccuggauggaggacaagacccccgugacgaccugggaggacguccccuaccucgggaagcgggaggaccaguggugcggcagccugaucgggcugaccucccgcgccaccugggcgcagaacaucccgacggccauccagcagguccggagccucaucggcaacgaggaguuccuggacuacaugcccuccaugaagcgcuuccggaaggaggaggagagcgagggggccaucugguga

SEQ ID NO: 9881 - RNA, 9873 nt, Artificial Sequence
  derived and/or modified CDS sequence (opt1) from DENV-3__FJ850094__SS-prME
accagccugugccucaugaugauccugcccgccgcccuggcguuccaccucaccagccgggacggcgagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgggacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgggacgcccaccuggaaccgcaaggagcuccuggugaccuucaagaacgcccacgccaagaagcaggaggucguggugcugggcucccaggagggggcgaugcacaccgcccucacgggcgccaccgagauccagaacagcgggggcaccuccaucuucgccggccaccugaagugccggcugaagauggacaagcucgagcugaaggggaugagcuacgccaugugcaccaacacguucguccugaagaaggagguguccgagacccagcacggcaccauccucaucaagguggaguacaagggggaggacgcgccgugcaagauccccuucagcaccgaggacggccagggcaaggcccacaacgggcgccugaucacggccaaccccgucgugaccaagaaggacgagcccgugaacaucgaggccgagccgcccuucggcgagagcaacaucgucaucgggaucggcgacaacgcgcugaagaucaacugguacaagaagggguccagcaucggcaagauguucgaggccaccgcccggggcgcccgccggauggccauccugggggacaccgcgugggacuucggcuccgucggcggggugcucaacagccuggggaagaugguccaccagaucuucggguccgccuacacggcccuguucagcggcguguccugggugaugaagaucgggaucggcguccuccugaccuggaucgggcugaacagcaagaacaccuccaugagcuucuccugcaucgccaucggcaucaucacccucuaccugggggccguggugcaggcggacaugggcugcgucgugaacuggaagggcaaggagcugaagugcgggagcggcaucuucgugacgaacgagguccacaccuggaccgagcaguacaaguuccaggccgacucccccaagcgccucgccaccgccaucgccggggcgugggagaacggcgugugcgggauccgcagcacgacccggauggagaaccugcuguggaagcagaucgccaacgagcucaacuacauccugugggagaacaacaucaagcugaccguggucgugggcgacaccaucggcgugcucgagcaggggaagcgcacgcugacgccccagccgauggagcugaaguacuccuggaagaccuggggcaaggccaagaucgucaccgccgagacgcagaacagcuccuucaucaucgacgggcccaacacccccgagugccccagcgcgucccgggccuggaacgugugggagguggaggacuacggcuucggcgucuucaccaccaacaucuggcucaagcugcgcgagguguacacccagcugugcgaccaccggcucaugagcgccgccgugaaggacgagcgcgccguccacgcggacaugggguacuggaucgagagccagaagaacggcuccuggaagcuggagaaggccagccugaucgaggugaagacgugcaccuggccgaagucccacacccucuggagcaacggggugcuggaguccgacaugaucauccccaagagccuggccggccccaucucccagcacaacuaccggccgggguaccacacccagacggccggccccuggcaccucggcaagcuggagcuggacuucaacuacugcgaggggaccaccgucgugaucaccgagaacugcggcacgcgcgggcccagccuccggaccaccaccguguccggcaagcugauccacgaguggugcugccgcagcugcacgcugcccccgcuccgguacaugggggaggacggcugcugguacggcauggagauccgccccaucuccgagaaggaggagaacauggucaagagccugguguccgccgggagcggcaagguggacaacuucaccauggggguccugugccucgcgauccuguucgaggaggugaugcggggcaaguucgggaagaagcacaugaucgccggcguguucuucaccuucguccugcuccuguccggccagaucaccuggcgcgacauggcccacacgcugaucaugaucgggagcaacgccuccgaccggaugggcaugggggugaccuaccucgcccugaucgcgaccuucaagauccagcccuuccuggcccucggcuucuuccugcgcaagcugaccagccgggagaaccuccugcugggcguggggcucgccauggccacgacccugcagcugcccgaggacaucgagcagauggcgaacggcaucgcccucgggcugauggcccugaagcucaucacccaguucgagaccuaccagcuguggacggcccugaucagccugaccugcuccaacaccauguucacccugacggucgccuggcgcaccgcgacccugauccucgccggcgugagccugcugccggucugccaguccagcuccaugcggaagaccgacuggcuccccauggccguggccgccaugggggugccgccccucccgcuguucaucuucagccucaaggacacguucaagcgccgcuccuggccccugaacgagggcgucauggcggugggccuggugagcauccucgccuccagccugcugcggaacgacguccccauggccgggccccucguggccggcgggcugcugaucgccugcuacgugaucaccggcaccuccgcggaccucaccgucgagaaggccgccgacaucacgugggaggaggaggccgagcagaccggggugagccacaaccugaugaucaccguggacgacgacggcaccaugcgcaucaaggacgacgagaccgagaacauccugacgguccuccugaagaccgcccugcucaucguguccggcguguucccguacagcauccccgcgacccugcuggucuggcacaccuggcagaagcagacgcagcgguccggggugcucugggacgugcccagcccgcccgagacccagaaggccgagcuggaggagggcgucuaccgcaucaagcagcaggggaucuucggcaagacccaggugggggugggcguccagaaggagggcguguuccacaccauguggcacgugacgcgcggggccguccugaccuacaacggcaagcgccucgagcccaacugggccuccgugaagaaggaccugaucagcuacgggggcggguggcggcuguccgcgcaguggcagaagggcgaggaggugcaggucaucgccguggagcccggcaagaaccccaagaacuuccagaccaugcccgggaccuuccagacgaccaccggcgagaucggggccaucgcccucgacuucaagcccggcaccagcggcagccccaucaucaaccgcgaggggaagguggucggccuguacgggaacggcguggugacgaagaacgggggcuacgucuccggcaucgcccagaccaacgcggagccggacgggcccacccccgagcuggaggaggagauguucaagaagcggaaccugaccaucauggaccuccaccccggcagcgggaagacgcgcaaguaccugccggccaucgugcgggaggccaucaagcgccggcugcgcacccucauccuggcccccacccggguggucgccgcggagauggaggaggcccugaagggccuccccauccgcuaccagaccacggccaccaaguccgagcacaccgggcgggagaucguggaccugaugugccacgccaccuucacgaugcgccugcucagccccgugcgggucccgaacuacaaccugaucaucauggacgaggcccacuucaccgaccccgcguccaucgccgcccgcggcuacaucagcacccgggugggcaugggggaggccgcggccaucuucaugaccgccacgccgcccggcaccgccgacgccuucccgcaguccaacgcgcccauccaggacgaggagcgcgacauccccgagcgcagcuggaacuccgggaacgaguggaucaccgacuucgccggcaagaccgugugguucguccccagcaucaaggccgggaacggcaucgccaacugccugcggaagaacggcaagaaggugauccagcucucccgcaagacguucgacaccgaguaccagaagaccaagcugaacgacugggacuucguggucaccacggacaucagcgagaugggggccaacuucaaggcggaccgggugaucgacccgcgccggugccugaagcccgugauccucaccgacggccccgagcgcgucauccuggccgggcccaugccggugaccgccgccuccgccgcgcagcggcgcggccggguggggcgcaacccccagaaggagaacgaccaguacaucuucaccggccagccccugaacaacgacgaggaccacgcccacuggaccgaggccaagaugcuccuggacaacaucaacacgcccgagggcaucaucccggcccuguucgagcccgagcgggagaaguccgcggccaucgacggggaguaccgccucaagggcgagucccggaagaccuucgucgagcugaugcgccgcggggaccugcccguguggcucgcccacaaggucgccagcgagggcaucaaguacaccgaccgcaaguggugcuucgacggccagcggaacaaccagauccuggaggagaacauggacguggagaucuggaccaaggagggggagaagaagaagcugcgcccccgguggcucgacgcccgcacguacuccgacccgcuggcgcugaaggaguucaaggacuucgccgccggccgcaagagcaucgcccucgaccuggugaccgagaucgggcggguccccucccaccuggcccaccgcacccggaacgcgcucgacaaccuggugaugcugcacaccagcgagcacggcgggcgcgccuaccggcacgccguggaggagcuccccgagacgauggagacccugcugcuccugggccugaugauccuccugaccggcggggccaugcuguuccucaucagcggcaaggggaucggcaagaccuccaucgggcugaucugcgucaucgccagcuccggcaugcuguggauggcggagaucccgcuccaguggaucgccagcgccaucgugcuggaguucuucaugauggugcugcucauccccgagcccgagaagcagcgcacgccccaggacaaccagcuggccuacgucgugaucggcauccugacccucgccgcgaucaucgccgccaacgagauggggcugcuggagaccaccaagcgggaccucggcauguccaaggagccggggguggucagccccacguccuaccuggacguggaccugcaccccgccagcgcguggacccucuacgccguggccaccaccgucaucacgcccaugcugcgccacaccaucgagaacuccaccgccaacgugagccuggccgcgaucgccaaccaggccgugguccucaugggccuggacaagggguggccgaucuccaagauggaccugggcgugccccuccuggcccugggcugcuacagccaggugaacccccucacccugacggccgcgguccugcuccugaucacccacuacgccaucaucgggcccggccugcaggccaaggccacccgggaggcccagaagcgcaccgcggccgggaucaugaagaacccgacgguggacggcaucaugaccaucgaccucgaccccgugaucuacgacuccaaguucgagaagcagcugggccaggucaugcugcucgugcugugcgccgugcagcugcuccugaugcggaccagcugggcccugugcgaggcgcucacccuggccacggggcccaucaccacccugugggagggcucccccgggaaguucuggaacaccacgaucgccgucagcauggccaacaucuuccgcggcuccuaccucgccggggcgggccuggccuucagcaucaugaaguccgugggcaccgggaagcggggcaccgggagccagggcgagacccugggggagaaguggaagaagaagcucaaccagcugagccgcaaggaguucgaccuguacaagaaguccggcaucaccgagguggaccggacggaggccaaggagggccucaagcgcggggagaccacccaccacgccgucagccggggcuccgccaagcugcagugguucguggagcgcaacauggugaucccggaggggcgggucaucgaccugggcugcgggcgcggcggcuggagcuacuacugcgcggggcucaagaaggugaccgaggugcggggcuacacgaagggcgggcccgggcacgaggagcccguccccauguccaccuacggcuggaacaucgugaagcugaugagcggcaaggacguguucuaccugccgcccgagaagugcgacacccuccugugcgacaucggggaguccagccccucccccaccgucgaggagagccgcacgauccgcgugcugaagaugguggagccguggcugaagaacaaccaguucugcaucaagauccucaaccccuacaugcccaccgucaucgagcaccuggagcggcugcagcgcaagcacggcgggaugcucgugcggaacccccugucccgcaacagcacccacgagauguacuggaucuccaacggcaccggcaacaucguggccagcgucaacauggugucccggcugcuccugaaccgcuucacgaugacccaccggcgcccgaccaucgagaaggacguggaccugggggccggcacccggcacgucaacgccgagcccgagacgcccaacauggacgugaucggggagcgcaucaagcggaucaaggaggagcacaacagcaccuggcacuacgacgacgagaacccguacaagaccugggccuaccacggcuccuacgaggugaaggcgaccgggagcgccuccagcaugaucaacggcgucgugaagcuccugacgaagcccugggacgucgugcccauggugacccagauggccaugaccgacaccacgcccuucggccagcagcgcgucuucaaggagaagguggacacccggaccccgcgcagcaugcccgggacccggcgcgugaugggcaucacggccgaguggcuguggcggacccucgggcgcaacaagaagccccggcugugcacccgcgaggaguucaccaagaagguccgcacgaacgcggccaugggcgccguguucaccgaggagaaccagugggacuccgccaaggccgcgguggaggacgaggacuucuggaagcuggucgaccgggagcgcgagcuccacaagcuggggaagugcggcagcugcguguacaacaugaugggcaagcgggagaagaagcugggggaguucggcaaggccaaggggucccgcgccaucugguacauguggcucggcgcccgguaccuggaguucgaggcccugggguuccucaacgaggaccacugguucagccgcgagaacuccuacagcggcguggagggcgaggggcugcacaagcugggcuacauccuccgggacaucuccaagauccccgggggcgcgauguacgccgacgacaccgccggcugggacacccgcaucacggaggacgaccugcacaacgaggagaagaucacccagcagauggacccggagcaccggcagcuggccaacgccaucuucaagcucaccuaccagaacaaggucgugaaggugcagcgccccacccccaccgggacggucauggacaucaucagccggaaggaccagcgcggcuccggccaggugggcaccuacgggcugaacaccuucaccaacauggaggcgcagcugauccggcagauggagggcgagggcgugcucagcaaggccgaccuggagaacccccaccuccccgagaagaagaucacgcaguggcuggagaccaagggggucgagcgccugaagcggauggccaucuccggcgacgacugcguggugaagcccaucgacgaccgcuucgccaacgcccugcucgcgcugaacgacauggggaagguccggaaggacaucccccaguggcagcccagcaagggcuggcacgacuggcagcaggucccguucugcucccaccacuuccacgagcugaucaugaaggacgggcgcaagcucgugguccccugccggccccaggacgagcugaucggccgcgcccggaucagccagggcgccggguggucccugcgcgagaccgccugccucggcaaggcguacgcccagauguggagccugauguacuuccaccgccgggaccugcgccucgccuccaacgccaucugcagcgccgugcccgugcacugggucccgaccucccggacgaccuggagcauccacgcgcaccaccaguggaugaccaccgaggacaugcugacgguguggaaccgcguguggaucgaggacaaccccuggauggaggacaagacccccgucaccaccugggaggacgugcccuaccuggggaagcgggaggaccaguggugcggcagccucaucgggcugacgucccgcgccaccugggcccagaacaucccgaccgccauccagcagguccggagccugaucggcaacgaggaguuccucgacuacaugcccuccaugaagcgcuuccggaaggaggaggagagcgagggcgccaucugguga

SEQ ID NO: 9882 - RNA, 9873 nt, Artificial Sequence
  derived and/or modified CDS sequence (opt1) from DENV-3__FJ898446__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggugaucuucauccugcugaugcucgugacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccggcugaucacggccaaccccgucgugaccaagaaggaggagcccgugaacaucgaggccgagccgcccuucggggagagcaacaucgucaucggcaccggggacaacgcgcugaagaucaacugguacaagaagggcuccagcaucgggaagauguucgagaccacggcccgcggcgcccggcgcauggccauccugggcgacaccgccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacacguccaugagcuucuccugcaucgccaucgggaucaucacccucuaccugggcgccguggugcaggccgacauggggugcgucaucaacuggaagggcaaggagcugaagugcggcagcgggaucuucgugaccaacgaggugcacaccuggacggagcaguacaaguuccaggcggacucccccaagcgccucgccaccgccaucgccggcgccugggagaacggggucugcggcauccggagcaccacccgcauggagaaccugcuguggaagcagaucgcgaacgagcucaacuacauccugugggagaacaacaucaagcugacggugguggucggggacaucaucggcgugcucgagcagggcaagcggacccugacgccccagccgauggagcugaaguacuccuggaagaccugggggaaggccaagaucgugacggccgagacccagaacagcuccuucaucaucgacggccccaacacccccgagugccccagcgccucccgcgcguggaacgucugggagguggaggacuacggguucggcguguucaccaccaacaucuggcucaagcugcgggaggucuacacgcagcugugcgaccaccgccucaugagcgccgccgugaaggacgagcgggccgugcacgccgacaugggcuacuggaucgagagccagaagaacggguccuggaagcuggagaaggcgagccugaucgaggucaagaccugcaccuggccgaagucccacacccucuggagcaacggcgugcuggaguccgacaugaucauccccaagagccuggccgggcccaucucccagcacaaccaccgcccgggcuaccacacgcagaccgccgggcccuggcaccucggcaagcuggagcuggacuucaacuacugcgagggcaccaccguggucaucacggagaacugcgggacccggggccccagccuccgcaccaccacgguguccgggaagcugauccacgaguggugcugccggagcugcacccugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgccauccuguucgaggaggucaugcgcgggaaguucggcaagaagcacaugaucgcggggguguucuucaccuucgugcugcuccuguccggccagaucacguggcgggacauggcccacacccugaucaugaucggcagcaacgccuccgaccgcauggggaugggcgucaccuaccucgcccugaucgccaccuucaagauccagcccuuccuggcgcucggguucuuccugcggaagcugacgagccgcgagaaccuccugcugggcgugggccucgccauggccaccacccugcagcugcccgaggacaucgagcagauggccaacgggaucgcgcucggccugauggcccugaagcucaucacccaguucgagacguaccagcuguggaccgcccugaucagccugaccugcuccaacaccauguucacgcugaccguggccuggcggaccgccacccugauccucgcgggggucagccugcugccggugugccaguccagcuccaugcgcaagacggacuggcuccccauggccgucgccgccaugggcgugccgccccucccgcuguucaucuucagccucaaggacacccugaagcgccgguccuggccccugaacgagggggugauggccgucggccucgugagcauccuggcguccagccugcuccgcaacgacgugcccauggccggcccccuggucgccgggggccugcucaucgccugcuacgugaucaccgggaccuccgccgaccugacgguggagaaggcggccgacaucaccugggaggaggaggccgagcagaccggcgucagccacaaccugaugaucaccguggacgacgacgggaccaugcggaucaaggacgacgagacggagaacauccucaccgugcugcugaagaccgcccuccugaucgucuccggcguguucccguacagcauccccgccacccugcucguguggcacacguggcagaagcagacccagcgcuccggcguccugugggacgugcccagcccgcccgagacccagaaggcggagcuggaggaggggguguaccggaucaagcagcagggcaucuucgggaagacccaggucggcgugggggugcagaaggagggcgucuuccacacgauguggcacgugacccgcggcgccgugcucaccuacaacgggaagcggcuggagcccaacugggccuccgucaagaaggaccugaucagcuacggcgggggcuggcgccucuccgcccaguggcagaagggggaggagguccaggugaucgcggucgagcccggcaagaaccccaagaacuuccagaccaugcccggcacguuccagaccaccaccggggagaucggcgccaucgcccuggacuucaagcccgggacgagcggcagccccaucaucaaccgggagggcaaggugguggggcuguacggcaacggggucgugaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggcgaucguccgcgaggccaucaagcggcgccuccggacccugauccuggcccccacccgcgugguggccgccgagauggaggaggcgcucaaggggcugcccauccgguaccagacgaccgccaccaaguccgagcacaccggccgcgagaucgucgaccugaugugccacgccacguucaccaugcggcuccugagccccgugcgcgugccgaacuacaaccugaucaucauggacgaggcccacuucaccgaccccgccuccaucgcggcccggggguacaucagcacccgcgucggcaugggcgaggccgccgcgaucuucaugacggccacgccgcccgggaccgccgacgccuucccgcaguccaacgcccccauccaggacgaggagcgcgacauccccgagcggagcuggaacuccggcaacgaguggaucaccgacuucgcggggaagacggugugguucgugcccagcaucaaggccggcaacgacaucgccaacugccuccgcaagaacgggaagaaggucauccagcugucccggaagaccuucgacaccgaguaccagaagaccaagcugaacgacugggacuucguggugacgaccgacaucagcgagaugggcgccaacuucaaggccgaccgcgucaucgacccgcggcgcugccucaagcccgugauccugaccgacggccccgagcgggugauccuggcggggcccaugccggucaccgccgccuccgccgcccagcgccggggccgcguggggcggaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgcgagaaguccgccgcgaucgacggcgaguaccggcugaagggcgagucccgcaagaccuucguggagcugaugcggcgcggggaccuccccgucuggcuggcccacaagguggccagcgagggcaucaaguacaccgaccggaaguggugcuucgacgggcagcgcaacaaccagauccuggaggagaacauggacgucgagaucuggacgaaggagggcgagaagaagaagcuccggccccgcuggcuggacgcccgcaccuacuccgacccgcuggcccucaaggaguucaaggacuucgcggccggccgcaagagcaucgcccuggaccuggugaccgagaucgggcgcgugcccucccaccucgcccaccggacccgcaacgcccuggacaaccuggucaugcuccacacgagcgagcacggcgggcgggcguaccgccacgccguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucguccuggaguucuucaugauggugcuccugauccccgagcccgagaagcagcggacgccccaggacaaccagcuggccuacguggucaucgggauccucacccuggccgccaucaucgcggccaacgagaugggccugcucgagaccacgaagcgcgaccugggcauguccaaggagccggggguggugagccccaccuccuaccuggacgucgaccuccaccccgccagcgccuggacccuguacgcgguggccaccacggugaucacccccaugcugcggcacaccaucgagaacuccaccgccaacgucagccucgccgccaucgcgaaccaggccguggugcugaugggccuggacaagggguggccgaucuccaagauggaccucggcgucccccugcuggcccucgggugcuacagccaggugaacccccugacgcugaccgccgccgugcuccugcugaucacccacuacgcgaucaucggccccggccuccaggccaaggccacccgcgaggcccagaagcggacggccgcggggaucaugaagaacccgaccgucgacggcaucaugaccaucgaccuggaccccgugaucuacgacuccaaguucgagaagcagcugggccaggugaugcuccugguccugugcgccgugcagcuccugcugaugcgcaccagcugggcccucugcgaggcccugacgcuggcgaccggccccaucaccacccucugggagggcucccccgggaaguucuggaacacgaccaucgccgugagcauggccaacaucuuccggggcuccuaccuggccggggccggccuggcguucagcaucaugaaguccgucgggaccggcaagcgcggcaccgggagccagggcgagacccucggggagaaguggaagaagaagcugaaccagcugagccggaaggaguucgaccucuacaagaaguccggcaucacggagguggaccgcaccgaggccaaggaggggcugaagcggggcgagaucacccaccacgccgugagccgcggcuccgccaagcugcagugguucgucgagcggaacauggugaucccggaggggcgcgugaucgaccucggcugcgggcggggcggguggagcuacuacugcgccggccugaagaaggucaccgaggugcgcggcuacacgaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccaccguggaggagagccgcacgauccggguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacccacgagauguacuggaucuccaacggcaccgggaacaucguggcgagcgucaacauggugucccgccuccugcugaaccgguucacgaugacccaccgccggccgaccaucgagaaggacguggaccucggcgccggcacccgccacgucaacgccgagcccgagacgcccaacauggacgugaucggggagcggaucaagcgcaucaaggaggagcacaacagcaccuggcacuacgacgacgagaacccguacaagaccugggccuaccacggcuccuacgaggugaaggccaccgggagcgcguccagcaugaucaacggcgucgugaagcugcugacgaagcccugggacgucgugcccauggugacccagauggccaugaccgacaccacgcccuucgggcagcagcgggucuucaaggagaagguggacacccgcaccccgcggagcaugcccggcacccgccgggugaugggcaucacggccgaguggcucuggcgcacccuggggcggaacaagaagccccgccugugcacccgcgaggaguucaccaagaagguccggacgaacgccgcgaugggcgccguguucaccgaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacaccgccgggugggacacccggaucacggaggacgaccugcacaacgaggagaagaucacccagcagauggacccggagcaccgccagcucgccaacgccaucuucaagcugaccuaccagaacaaggucgugaaggugcagcggcccacccccaccggcacggucauggacaucaucagccgcaaggaccagcggggcuccggccaggugggcaccuacgggcugaacaccuucaccaacauggaggcccagcucauccgccagauggagggcgagggggugcugagcaaggcggaccuggagaacccccaccucccggagaagaagaucacgcaguggcuggagaccaagggcgucgagcggcugaagcgcauggccaucuccggcgacgacugcguggugaagcccaucgacgaccgguucgccaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcgcgcaucagccagggggccggcuggucccuccgcgagaccgccugccugggcaaggccuacgcgcagauguggagccugauguacuuccaccggcgcgaccuccggcuggccuccaacgccaucugcagcgccgugcccgugcacugggucccgaccucccgcacgaccuggagcauccacgcccaccaccaguggaugaccaccgaggacaugcugacgguguggaaccggguguggaucgaggacaaccccuggauggaggacaagacccccgucaccaccugggagaacgugcccuaccucgggaagcgcgaggaccaguggugcggcagccugaucgggcugacgucccgggcgaccugggcccagaacaucccgaccgccauccagcagguccgcagccucaucggcaacgaggaguuccuggacuacaugcccuccaugaagcgguuccgcaaggaggaggagagcgagggggccaucugguga

SEQ ID NO: 9883 - RNA, 9873 nt, Artificial Sequence
  derived and/or modified CDS sequence (opt1) from DENV-3__GU131844__SS-prME
accagccugugccugaugaugauccugcccgccgcccuggcguuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaaggucgagacgugggcccugcggcaccccggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugcccgaggagcaggaccagaacuacgucugcaagcacaccuacguggaccgcggguggggcaacgggugcggccucuucgggaagggcucccuggugaccugcgccaaguuccagugccuggagcucaucgagggcaaggucgugcaguacgagaaccugaaguacaccgugaucaucacgguccacaccggggaccagcaccaggugggcaacgagacccagggggucaccgccgagaucacgccccaggccagcaccaccgaggcgauccugcccgaguacggcacccucgggcuggagugcagcccccggaccggccuggacuucaacgagaugauccuccugacgaugaagaacaaggccuggauggugcaccgccagugguucuucgaccugccgcuccccuggaccagcggcgccaccaccgagacgcccaccuggaaccggaaggagcugcuggugaccuucaagaacgcccacgccaagaagcaggaggucguggugcucgggucccaggagggcgcgaugcacaccgcccugacgggggccaccgagauccagaacagcggcgggaccuccaucuucgccggccaccugaagugccgccucaagauggacaagcuggagcugaagggcaugagcuacgccaugugcaccaacacguucguccucaagaaggagguguccgagacccagcacgggaccauccugaucaagguggaguacaagggcgaggacgcgcccugcaagaucccguucagcaccgaggacgggcagggcaaggcccacaacggccggcugaucacggccaaccccgucgugaccaagaaggaggagcccgugaacaucgaggccgagcccccguucggggagagcaacaucgucaucggcaccggggacaacgcgcugaagaucaacugguacaagaagggcuccagcaucgggaagauguucgaggccaccgcccgcggcgcccggcgcauggccauccucggcgacacggcgugggacuucggguccgugggcggggugcugaacagccugggcaagaugguccaccagaucuucggguccgccuacaccgcccucuucagcggcguguccugggugaugaagaucggcaucgggguccugcugaccuggaucggccucaacagcaagaacaccuccaugagcuucuccugcaucgccaucgggaucaucacgcuguaccugggcgccguggugcaggcggacauggggugcgucaucaacuggaagggcaaggagcucaagugcggcagcgggaucuucgugaccaacgaggugcacaccuggaccgagcaguacaaguuccaggccgacucccccaagcgccuggccacggccaucgccggcgcgugggagaacggggucugcggcauccggagcaccacccgcauggagaaccugcucuggaagcagaucgccaacgagcugaacuacauccugugggagaacaacgugaagcucaccguggucgugggggacaucaucggcgugcuggagcagggcaagcggacgcugacgccccagcccauggagcucaaguacuccuggaagaccugggggaaggccaagaucgucaccgccgagacgcagaacagcuccuucaucaucgacggcccgaacacccccgagugccccagcgcgucccgcgccuggaacgugugggagguggaggacuacggguucggcgucuucaccaccaacaucuggcugaagcugcgggagguguacacccagcucugcgaccaccgccugaugagcgccgccgugaaggacgagcgggccguccacgcggacaugggcuacuggaucgagagccagaagaacggguccuggaagcuggagaaggccagccucaucgaggugaagacgugcaccuggcccaagucccacacccuguggagcaacggcgugcuggaguccgacaugaucauccccaagucccucgccgggcccaucucccagcacaaccaccgccccggcuaccacacccagacggccgggccguggcaccugggcaagcuggagcucgacuucaacuacugcgagggcaccaccgucgugaucaccgagaacugcgggacgcggggccccagccugcgcaccaccaccguguccgggaagcugauccacgaguggugcugccggagcugcacgcugccgccccuccgcuacaugggcgaggacgggugcugguacggcauggagauccggccgaucuccgagaaggaggagaacauggucaagagccugguguccgccggcagcgggaagguggacaacuucaccaugggcguccucugccuggcgauccuguucgaggaggugaugcgcgggaaguucggcaagaagcacaugaucgccgggguguucuucaccuucguccuccugcuguccggccagaucaccuggcgggacauggcccacacgcucaucaugaucggcagcaacgccuccgaccgcauggggaugggcgugaccuaccuggcccugaucgcgaccuucaagauccagcccuuccucgcccugggguucuuccugcggaagcucaccagccgcgagaaccugcugcucggcgugggccuggccauggccacgacccugcagcuccccgaggacaucgagcagauggcgaacgggaucgcccugggccugauggcccucaagcugaucacccaguucgagaccuaccagcuguggacggcccucaucagccugaccugcuccaacaccauguucacccugacggucgccuggcggaccgcgacccucauccuggccggggugagccugcuccccgucugccaguccagcuccaugcgcaagaccgacuggcugccgauggccguggccgccaugggcgugccgccccugccccucuucaucuucagccugaaggacacgcugaagcgccgguccuggccgcucaacgagggggucauggcggugggccuggugagcauccuggccuccagccuccugcgcaacgacguccccauggccggcccccugguggccgggggccuccugaucgccugcuacgugaucaccgggaccuccgcggaccugaccgucgagaaggccgccgacaucacgugggaggaggaggccgagcagaccggcgugagccacaaccucaugaucaccguggacgacgacgggaccaugcggaucaaggacgacgagaccgagaacauccugacgguccugcucaagaccgcccugcugaucguguccggcguguuccccuacagcaucccggcgacccuccuggucuggcacaccuggcagaagcagacgcagcgcuccggcgugcugugggacgugcccuccccgcccgagacccagaaggccgagcucgaggagggggucuaccggaucaagcagcagggcaucuucgggaagacccaggugggcguggggguccagaaggagggcguguuccacaccauguggcacgugacgcgcggcgccguccugaccuacaacgggaagcggcuggagccgaacugggccuccgugaagaaggaccucaucagcuacggcgggggcuggcgccuguccgcgcaguggcagaagggggaggaggugcaggucaucgccguggagcccggcaagaaccccaagaacuuccagaccaugcccggcaccuuccagacgaccaccggggagaucggcgccaucgcccuggacuucaagccggggaccagcggcagccccaucaucaaccgggagggcaagguggucgggcuguacggcaacgggguggugacgaagaacggcggguacgucuccggcaucgcccagaccaacgcggagcccgacggcccgacccccgagcucgaggaggagauguucaagaagcgcaaccugaccaucauggaccugcaccccgggagcggcaagacgcggaaguaccuccccgccaucgugcgcgaggccaucaagcggcgccugcggacccugauccucgccccgacccgcguggucgccgcggagauggaggaggcccugaaggggcugcccauccgguaccagaccacggccaccaaguccgagcacaccggccgcgagaucguggaccucaugugccacgccaccuucacgaugcggcugcugagccccgugcgcguccccaacuacaaccucaucaucauggacgaggcccacuucaccgacccggcguccaucgccgcccggggguacaucagcacccgcgugggcaugggcgaggccgcggccaucuucaugaccgccacgccgcccgggaccgccgacgccuucccccaguccaacgcgccgauccaggacgaggagcgcgacauccccgagcggagcuggaacuccggcaacgaguggaucaccgacuucgccgggaagaccgugugguucguccccagcaucaaggccggcaacgacaucgccaacugccugcgcaagaacgggaagaaggugauccagcugucccggaagacguucgacaccgaguaccagaagaccaagcucaacgacugggacuucguggucaccacggacaucagcgagaugggcgccaacuucaaggcggaccgcgugaucgacccccggcgcugccugaagccggugauccugaccgacggccccgagcgggucauccucgccgggcccaugcccgugaccgccgccuccgccgcgcagcgccggggccgcguggggcggaacccgcagaaggagaacgaccaguacaucuucaccggccagccccugaacaacgacgaggaccacgcccacuggaccgaggccaagaugcugcucgacaacaucaacacgcccgaggggaucauccccgcccuguucgagccggagcgcgagaaguccgcggccaucgacggcgaguaccggcugaagggcgagucccgcaagaccuucgucgagcucaugcggcgcggggaccugcccguguggcuggcccacaaggucgccagcgagggcaucaaguacaccgaccggaaguggugcuucgacgggcagcgcaacaaccagauccucgaggagaacauggacguggagaucuggaccaaggagggcgagaagaagaagcugcggccccgcuggcuggacgcccgcacguacuccgacccccucgcgcugaaggaguucaaggacuucgccgccggccgcaagagcaucgcccuggaccucgugaccgagaucgggcgcgucccgucccaccuggcccaccggacccgcaacgcgcuggacaaccucgugaugcugcacaccagcgagcacggcgggcgggccuaccgccacgccguggaggagcugcccgagacgauggagacccuccugcugcucggccugaugauccugcucaccgggggcgccaugcuguuccugaucagcggcaaggggaucggcaagaccuccaucgggcucaucugcgucaucgccagcuccggcaugcuguggauggcggagaucccccugcaguggaucgccagcgccaucgugcucgaguucuucaugauggugcugcugaucccggagcccgagaagcagcggacgccccaggacaaccagcucgccuacgucgugaucgggauccugacccuggccgcgaucaucgccgccaacgagaugggccuccuggagaccaccaagcgcgaccugggcauguccaaggagcccgggguggucagcccgacguccuaccucgacguggaccugcaccccgccagcgcguggacccuguacgccguggccaccaccgucaucacgcccaugcuccggcacaccaucgagaacuccaccgccaacgugagccuggccgcgaucgccaaccaggccgugguccugaugggccucgacaagggguggcccaucuccaagauggaccugggcgugccgcugcucgcccuggggugcuacagccaggugaacccccugacccucacggccgcgguccugcugcucaucacccacuacgccaucaucggccccggccugcaggccaaggccacccgcgaggcccagaagcggaccgcggccgggaucaugaagaaccccacgguggacggcaucaugaccaucgaccuggacccggugaucuacgacuccaaguucgagaagcagcucgggcaggucaugcugcuggugcucugcgccgcccagcugcugcucaugcgcaccagcugggcgcugugcgaggcccugacccucgccacgggccccaucaccacccugugggagggcucccccgggaaguucuggaacaccacgaucgccgugagcauggccaacaucuuccggggcuccuaccuggcgggggccggccucgccuucagcaucaugaaguccgucgggaccggcaagcgcggcaccgggagccagggcgagacccugggggagaaguggaagaagaagcugaaccagcucagccggaaggaguucgaccuguacaagaaguccggcaucaccgagguggaccgcacggaggccaaggaggggcugaagcggggcgagaucacccaccacgccgugagccgcggcuccgcgaagcuccagugguucgucgagcggaacauggugauccccgaggggcgcgugaucgaccugggcugcgggcggggcggguggagcuacuacugcgccggccugaagaaggucaccgaggugcgcggcuacaccaagggcgggccggggcacgaggagcccgugcccauguccacguacggcuggaacaucgucaagcucaugagcgggaaggacguguucuaccugcccccggagaagugcgacacccugcugugcgacaucggcgaguccagccccucccccaccguggaggagagccgcaccauccggguccucaagaugguggagcccuggcugaagaacaaccaguucugcaucaaggugcugaacccguacaugcccacggucaucgagcaccucgagcgccugcagcggaagcacggcgggaugcuggugcgcaacccccucucccggaacagcacccacgagauguacuggaucuccaacggcaccgggaacaucguggccagcgucaacauggugucccgccugcugcucaaccgguucaccaugacgcaccgccggcccaccaucgagaaggacguggaccugggcgccggcacccgccacgucaacgccgagccggagacccccaacauggacgugaucggggagcggaucaagcgcaucaaggaggagcacaacagcacguggcacuacgacgacgagaaccccuacaagaccugggcguaccacggcuccuacgaggugaaggccaccgggagcgccuccagcaugaucaacggcgucgugaagcugcucaccaagccgugggacgucgugcccauggugacgcagauggccaugaccgacaccacccccuucgggcagcagcgggucuucaaggagaagguggacacgcgcacgccccggagcaugccgggcacccgccgggugaugggcaucaccgcggaguggcuguggcgcacccuggggcggaacaagaagccccgccucugcacccgcgaggaguucaccaagaagguccggaccaacgccgccaugggcgccguguucacggaggagaaccagugggacuccgccaaggcggccguggaggacgaggacuucuggaagcuggucgaccgcgagcgggagcugcacaagcucgggaagugcggcagcugcguguacaacaugauggggaagcgcgagaagaagcugggcgaguucggcaaggccaaggggucccgggccaucugguacauguggcugggcgcccgcuaccucgaguucgaggcgcugggguuccugaacgaggaccacugguucagccgggagaacuccuacagcggcguggagggggagggccuccacaagcugggcuacauccugcgcgacaucuccaagauccccgggggcgccauguacgccgacgacaccgccgggugggacacccggaucaccgaggacgaccuccacaacgaggagaagaucacgcagcagauggaccccgagcaccgccagcuggccaacgcgaucuucaagcugaccuaccagaacaaggucgugaaggugcagcggccgacccccaccggcaccgucauggacaucaucagccgcaaggaccagcggggcuccggccaggugggcacguacgggcucaacaccuucaccaacauggaggcccagcugauccgccagauggagggcgagggggugcugagcaaggccgaccucgagaacccccaccuccccgagaagaagaucgcccaguggcuggagaccaagggcgucgagcggcucaagcgcauggccaucuccggcgacgacugcguggugaagccgaucgacgaccgguucgcgaacgcccugcuggcccucaacgacauggggaagguccgcaaggacaucccccaguggcagcccagcaagggcuggcacgacuggcagcagguccccuucugcucccaccacuuccacgagcugaucaugaaggacgggcggaagcugguggucccgugccgcccccaggacgagcucaucggccgggcccgcaucagccagggguccggcuggagccugcgcgagacggcgugccugggcaaggccuacgcccagauguggucccucauguacuuccaccggcgcgaccugcggcuggccagcaacgccaucugcuccgcggugcccgugcacuggguccccaccagccgcaccaccuggagcauccacgcccaccaccaguggaugacgaccgaggacaugcucgccguguggaaccggguguggaucgaggacaacccguggauggaggacaagacccccgucaccacgugggagaacgugcccuaccuggggaagcgcgaggaccaguggugcggcucccugaucgggcucaccagccgggccaccugggcccagaacauccccaccgcgauccagcagguccgcucccugaucggcaacgaggaguuccuggacuacaugccgagcaugaagcgguuccgcaaggaggaggaguccgagggggccaucugguga

SEQ ID NO: 9884 - RNA, 9873 nt, Artificial Sequence
  derived and/or modified CDS sequence (opt1) from DENV-3__GU131849__SS-prME
accagccucugccucgugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcggcgccgggacaagcgcuccguggcccucgcgccccacgugggcauggggcuggacacccggacccagaccuggaugagcgccgagggcgccuggcgccaggucgagaagguggagacgugggcccugcggcacccgggguucaccauccucgcgcuguuccuggcccacuacaucggcaccucccucacccagaagguggucaucuucauccugcugaugcucgugacgcccagcaugaccaugcgcugcgugggggucggcaaccgggacuucguggagggccuguccggggccaccuggguggacgucgugcuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccguccugccggaggagcaggaccagaacuacgugugcaagcacaccuacguggaccgcggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaucgaggcgauccugcccgaguacggcacccuggggcucgagugcuccccgcggaccggccuggacuucaacgagaugauccugcucaccaugaagaacaaggccuggauggugcaccgccagugguucuucgaccugccccugcccuggacgagcggcgccaccaccgagacccccacguggaaccggaaggagcuccuggucaccuucaagaacgcccacgccaagaagcaggagguggugguccuggggucccaggagggcgcgaugcacaccgcccucaccggggccacggagauccagaacagcggcgggaccuccaucuucgccggccaccugaagugccgccugaagauggacaagcucgagcugaagggcaugagcuacgccaugugcaccaacaccuucgugcugaagaaggagguguccgagacgcagcacgggaccauccucaucaaggucgaguaccggggcgaggacgcgccgugcaagauccccuucagcaccgaggacgggcagggcaaggcccacaacggccgccugaucaccgccaaccccguggugacgaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcgggguccucaacagccugggcaagauggugcaccagaucuucggguccgccuacaccgcccuguucagcggcguguccugggucaugaagaucggcaucgggauccuccugacguggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugaccaacgaggugcacacguggaccgagcaguacaaguuccaggccgacucccccaagcggcucgccaccgccaucgccggcgcgugggagaacggggucugcggcauccgcagcaccacgcggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagacgugggggaaggccaagaucgugaccgccgagacccagaacagcuccuucaucaucgacggccccaacacccccgagugccccagcgcgucccgggccuggaacgucugggagguggaggacuacggguucggcguguucacgaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcaccuggccgaagucccacacgcucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcaccacgguggucaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucaccaugggcgugcugugccucgcgauccuguucgaggaggucaugcgggggaaguucggcaagaagcacaugaucgccgggguguucuucacguucgugcugcuccuguccggccagaucaccuggcgcgacaugacccacacccugaucaugaucggcagcaacgccuccgaccggauggggaugggcgucacguaccucgcccugaucgccaccuucaagauccagcccuuccuggcgcucggguucuuccugcgcaagcugaccagccgggagaaccuccugcugggcgugggccucgccauggccaccaugcugcagcugcccgaggacaucgagcagauggccaacgggaucgcgcucggccugauggcccugaagcucaucacgcaguucgagaccuaccagcuguggaccgcccugaucagccugaccugcuccaacacgauguucacccugaccguggccuggcgcaccgccacgcugauccucgcgggggucagccugcugccggugugccaguccagcuccaugcgcaagaccgacuggcuccccauggccgucgccgccaugggcgugccgccccucccgcuguucaucuucagccucaaggacacccugaagcggcgcuccuggccccugaacgagggggugauggccgucggccucgugagcauccuggcguccagccugcuccggaacgacgugcccauggccggcccccuggucgccgggggccugcucaucgccugcuacgugaucaccgggacguccgccgaccugaccguggagaaggcggccgacaucaccugggaggaggaggccgagcagaccggcgucagccacaaccugaugaucacgguggacgacgacgggaccaugcgcaucaaggacgacgagaccgagaacauccucaccgugcugcugaagaccgcccuccugaucgucuccggcguguucccguacagcauccccgccacgcugcucguguggcacaccuggcagaagcagacccagcgguccggcguccugugggacgugcccagcccgcccgagacccagaaggcggagcuggaggaggggguguaccgcaucaagcagcagggcaucuucgggaagacgcaggucggcgugggggugcagaaggagggcgucuuccacaccauguggcacgugacccggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagacgacccccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggcgaucauccgggaggccaucaagcgccggcuccgcacgcugauccuggcccccacccgggucguggccgccgagauggaggaggcgcucaaggggcugcccauccgcuaccagaccaccgccacgaaguccgagcacaccggccgggagaucguggaccugaugugccacgccaccuucaccaugcgccuccugagccccguccgggugccgaacuacaaccugaucaucauggacgaggcccacuucacggaccccgccuccaucgcggcccgcggguacaucagcacccgcgugggcaugggcgaggccgccgcgaucuucaugaccgccacgccgcccgggacggccgacgccuucccgcaguccaacgcccccauccaggacgaggagcgggacauccccgagcgcagcuggaacuccggcaacgaguggaucaccgacuucgcggggaagaccgucugguucgugcccagcaucaaggccggcaacgacaucgccaacugccuccggaagaacgggaagaaggugauccagcugucccgcaagaccuucgacacggaguaccagaagaccaagcugaacgacugggacuucgucgugaccaccgacaucagcgagaugggcgccaacuucaaggccgaccgggugaucgacccgcgccggugccucaagcccgucauccugacggacggccccgagcgcgugauccuggcggggcccaugccggugaccgccgccuccgccgcccagcggcgcggccgggucgggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagacguucguggagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgcuggcuggacgcccggaccuacuccgacccgcuggcccucaaggaguucaaggacuucgcggccggccgcaagagcaucgcccuggaccuggucacggagaucgggcgggugcccucccaccucgcccaccgcacccggaacgcccuggacaaccuggugaugcuccacaccagcgagcacggcgggcgcgcguaccggcacgccgucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucgugcuggaguucuucaugaugguccuccugauccccgagcccgagaagcagcgcacgccccaggacaaccagcuggccuacguggugaucgggauccucacgcuggccgccaucaucgcggccaacgagaugggccugcucgagaccaccaagcgggaccugggcauguccaaggagccgggggucgugagccccaccuccuaccuggacguggaccuccaccccgccagcgccuggacgcuguacgcggucgccaccaccgugaucacccccaugcugcgccacacgaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacccugaccgccgccgugcuccugcugaucacgcacuacgcgaucaucggccccggccuccaggccaaggccacccgggaggcccagaagcgcaccgccgcggggaucaugaagaacccgaccguggacggcaucaugacgaucgaccuggaccccgucaucuacgacuccaaguucgagaagcagcugggccaggugaugcuccuggugcugugcgccguccagcuccugcugaugcggaccagcugggcccucugcgaggcccugacccuggcgaccggccccaucacgacccucugggagggcucccccgggaaguucuggaacaccaccaucgccgugagcauggccaacaucuuccgcggcuccuaccuggccggggccggccuggcguucagcaucaugaaguccguggggacgggcaagcggggcaccgggagccagggcgagacccucggggagaaguggaagaagaagcugaaccagcugagccgcaaggaguucgaccucuacaagaaguccggcaucaccgaggucgaccggaccgaggccaaggaggggcugaagcgcggcgagaucacgcaccacgccgugagccggggcuccgccaagcugcagugguucguggagcgcaacauggucaucccggaggggcgggugaucgaccucggcugcgggcgcggcggguggagcuacuacugcgccggccugaagaaggugaccgagguccgcggcuacaccaagggcgggcccgggcacgaggagcccgugcccauguccaccuacggcuggaacaucgugaagcugaugagcgggaaggacgucuucuaccucccgcccgagaagugcgacacgcugcugugcgacaucggcgaguccagccccucccccaccguggaggagagccggaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugucccgcaacagcacgcacgagauguacuggaucuccaacggcaccgggaacaucguggcgagcgugaacauggucucccggcuccugcugaaccgcuucaccaugacccaccggcgcccgacgaucgagaaggacguggaccucggcgccggcacccggcacgugaacgccgagcccgagacccccaacauggacgucaucggggagcgcaucaagcggaucaaggaggagcacaacagcaccuggcacuacgacgacgagaacccguacaagacgugggccuaccacggcuccuacgaggugaaggccaccgggagcgcguccagcaugaucaacggcguggucaagcugcugaccaagcccugggacgugguccccauggugacccagauggccaugacggacaccacccccuucgggcagcagcgcguguucaaggagaaggucgacacccggacgccgcgcagcaugcccggcacccggcgcgugauggagaucaccgccgaguggcucuggcggacccugggccgcaacaagaagccccgccugugcacgcgggaggaguucaccaagaaggugcgcaccaacgccgcgaugggggccgucuucaccgaggagaaccagugggacuccgccaaggccgccguggaggacgaggacuucuggaagcucguggaccgggagcgcgagcugcacaagcugggcaagugcgggagcugcgucuacaacaugaugggcaagcgggagaagaagcucggggaguucggcaaggcgaagggcucccgcgccaucugguacauguggcugggggcccgguaccuggaguucgaggcccucggcuuccugaacgaggaccacugguucagccgcgagaacuccuacagcgggguggagggcgaggggcugcacaagcucggcuacauccugcgggacaucuccaagauccccggcggggccauguacgcggacgacacggccggcugggacacccgcaucaccgaggacgaccugcacaacgaggagaagaucacccagcagauggacccggagcaccggcagcucgccaacgccaucuucaagcugacguaccagaacaagguggucaaggugcagcgccccacccccaccgggaccgugauggacaucaucagccggaaggaccagcgcggcuccggccaggucgggaccuacggccugaacacguucaccaacauggaggcccagcucauccggcagauggagggggagggcgugcugagcaaggcggaccuggagaacucccaccuccccgagaagaagaucacccaguggcuggagaccaaggggguggagcgccugaagcggauggccaucagcggcgacgacugcgucgugaagccgaucgacgaccgcuucgccaacgcccuccuggcccugaacgacaugggcaaggugcggaaggacaucccccaguggcagcccuccaagggguggcacgacuggcagcagguccccuucugcagccaccacuuccacgagcucaucaugaaggacggccgcaagcugguggugccgugccggccccaggacgagcugaucgggcgcgcgcgcaucucccagggcgccggguggagccuccgggagacggccugccugggcaaggccuacgcgcagauguggucccugauguacuuccaccgccgggaccuccgccuggccagcaacgccaucugcuccgccguccccgugcacugggugcccaccagccggaccaccuggagcauccacgcccaccaccaguggaugacgaccgaggacaugcugaccgucuggaaccgcguguggaucgaggacaacccguggauggaggacaagacccccgugacgaccugggagaacguccccuaccucggcaagcgggaggaccaguggugcgggucccugaucggccugaccagccgcgcgaccugggcccagaacauccccacggccauccagcagguccggucccucaucgggaacgaggaguuccuggacuacaugccgagcaugaagcgcuuccggaaggaggaggaguccgagggcgccaucugguga

SEQ ID NO: 9885 - RNA, 9873 nt, Artificial Sequence
  derived and/or modified CDS sequence (opt1) from DENV-3__GQ868546__SS-prME
accagccucugccucgugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccaggucgagaagguggagacgugggcccugcggcacccgggguucaccauccucgcgcuguuccuggcccacuacaucggcaccucccucacccagaagguggucaucuucauccugcugaugcucgugacgcccagcaugaccaugcgcugcgugggggucggcaaccgggacuucguggagggccuguccggggccaccuggguggacgucgugcuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccguccugccggaggagcaggaccagaacuacgugugcaagcacaccuacguggaccgcggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucgugcugaagaaggagguguccgagacccagcacgggaccauccucaucaaggucgaguaccggggcgaggacgcgccgugcaagauccccuucagcaccgaggacgggcagggcaaggcccacaacggccgccugaucacggccaaccccguggugaccaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcgggguccucaacagccugggcaagauggugcaccagaucuucggguccgccuacacggcccuguucagcggcguguccugggucaugaagaucggcaucgggauccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcggcucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacaugacccacacgcugaucaugaucggcagcaacgccuccgaccggauggggaugggcgucaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccauguucacccugacgguggccuggcgcaccgccacccugauccucgcgggggucagccugcugccggugugccaguccagcuccaugcgcaagaccgacuggcuccccauggccgucgccgccaugggcgugccgccccucccgcuguucaucuucagccucaaggacacgcugaagcggcgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugaccguggagaaggcggccgacaucacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcguguucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccacccccggcacguuccagaccaccaccggggagaucggcgccaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucauccgggaggccaucaagcgccggcuccgcacccugauccuggcccccacccgggucguggccgccgagauggaggaggcgcucaaggggcugcccauccgcuaccagacgaccgccaccaaguccgagcacaccggccgggagaucguggaccugaugugccacgccacguucaccaugcgccuccugagccccguccgggugccgaacuacaaccugaucaucauggacgaggcccacuucaccgaccccgccuccaucgcggcccgcggguacaucagcacccgcgugggcaugggcgaggccgccgcgaucuucaugacggccacgccgcccgggaccgccgacgccuucccgcaguccaacgcccccauccaggacgaggagcgggacauccccgagcgcagcuggaacuccggcaacgaguggaucaccgacuucgcggggaagacggucugguucgugcccagcaucaaggccggcaacgacaucgccaacugccuccggaagaacgggaagaaggugauccagcugucccgcaagaccuucgacaccgaguaccagaagaccaagcugaacgacugggacuucgucgugacgaccgacaucagcgagaugggcgccaacuucaaggccgaccgggugaucgacccgcgccggugccucaagcccgucauccugaccgacggccccgagcgcgugauccuggcggggcccaugccggugaccgccgccuccgccgcccagcggcgcggccgggucgggcgcaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgggagaaguccgccgcgaucgacggcgaguaccgccugaagggcgagucccggaagaccuucguggagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggacgaaggagggcgagaagaagaagcuccgcccccgcuggcuggacgcccggaccuacuccgacccgcuggcccucaaggaguucaaggacuucgcggccggccgcaagagcaucgcccuggaccuggucaccgagaucgggcgggugcccucccaccucgcccaccgcacccggaacgcccuggacaaccuggugaugcuccacacgagcgagcacggcgggcgcgcguaccggcacgccgucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucgugcuggaguucuucaugaugguccuccugauccccgagcccgagaagcagcgcacgccccaggacaaccagcuggccuacguggugaucgggauccucacccuggccgccaucaucgcggccaacgagaugggccugcucgagaccacgaagcgggaccugggcauguccaaggagccgggggucgugagccccaccuccuaccuggacguggaccuccaccccgccagcgccuggacccuguacgcggucgccaccacggugaucacccccaugcugcgccacaccaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacgcugaccgccgccgugcuccugcugaucacccacuacgcgaucaucggccccggccuccaggccaaggccacccgggaggcccagaagcgcacggccgcggggaucaugaagaacccgaccguggacggcaucaugaccaucgaccuggaccccgucaucuacgacuccaaguucgagaagcagcugggccaggugaugcuccuggugcugugcgccguccagcuccugcugaugcggaccagcugggcccucugcgaggcccugacgcuggcgaccggccccaucaccacccucugggagggcucccccgggaaguucuggaacacgaccaucgccgugagcauggccaacaucuuccgcggcuccuaccuggccggggccggccuggcguucagcaucaugaaguccguggggaccggcaagcggggcaccgggagccagggcgagacccucggggagaaguggaagaagaagcugaaccagcugagccgcaaggaguucgaccucuacaagaaguccggcaucacggaggucgaccggaccgaggccaaggaggggcugaagcgcggcgagaucacccaccacgccgugagccggggcuccgccaagcugcagugguucguggagcgcaacauggucaucccggaggggcgggugaucgaccucggcugcgggcgcggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccggacgauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugucccgcaacagcacccacgagauguacuggaucuccaacggcaccgggaacaucguggcgagcgugaacauggucucccggcuccugcugaaccgcuucacgaugacccaccggcgcccgaccaucgagaaggacguggaccucggcgccggcacccggcacgugaacgccgagcccgagacgcccaacauggacgucaucggggagcgcaucaagcggaucaaggaggagcacaacagcaccuggcacuacgacgacgagaacccguacaagaccugggccuaccacggcuccuacgaggugaaggccaccgggagcgcguccagcaugaucaacggcguggucaagcugcugacgaagcccugggacgugguccccauggugacccagauggccaugaccgacaccacgcccuucgggcagcagcgcguguucaaggagaaggucgacacccggaccccgcgcagcaugcccggcacccggcgcgugauggagaucacggccgaguggcucuggcggacccugggccgcaacaagaagccccgccugugcacccgggaggaguucaccaagaaggugcgcacgaacgccgcgaugggggccgucuucaccgaggagaaccagugggacuccgccaaggccgccguggaggacgaggacuucuggaagcucguggaccgggagcgcgagcugcacaagcugggcaagugcgggagcugcgucuacaacaugaugggcaagcgggagaagaagcucggggaguucggcaaggcgaagggcucccgcgccaucugguacauguggcugggggcccgguaccuggaguucgaggcccucggcuuccugaacgaggaccacugguucagccgcgagaacuccuacagcgggguggagggcgaggggcugcacaagcucggcuacauccugcgggacaucuccaagauccccggcggggccauguacgcggacgacaccgccggcugggacacccgcaucacggaggacgaccugcacaacgaggagaagaucacccagcagauggacccggagcaccggcagcucgccaacgccaucuucaagcugaccuaccagaacaagguggucaaggugcagcgccccacccccaccgggacggugauggacaucaucagccggaaggaccagcgcggcuccggccaggucgggaccuacggccugaacaccuucaccaacauggaggcccagcucauccggcagauggagggggagggcgugcugagcaaggcggaccuggagaacccccaccucccggagaagaagaucacgcaguggcuggagaccaaggggguggagcgccugaagcggauggccaucuccggcgacgacugcgucgugaagcccaucgacgaccgcuucgccaacgcccuccuggcccugaacgacaugggcaaggugcggaaggacaucccccaguggcagcccagcaagggguggcacgacuggcagcaggucccguucugcucccaccacuuccacgagcucaucaugaaggacggccgcaagcugguggugcccugccggccccaggacgagcugaucgggcgcgcgcgcaucagccagggcgccggguggucccuccgggagaccgccugccugggcaaggccuacgcgcagauguggagccugauguacuuccaccgccgggaccuccgccuggccuccaacgccaucugcagcgccguccccgugcacugggugccgaccucccggacgaccuggagcauccacgcccaccaccaguggaugaccaccgaggacaugcugacggucuggaaccgcguguggaucgaggacaaccccuggauggaggacaagacccccgugaccaccugggagaacguccccuaccucggcaagcgggaggaccaguggugcgggagccugaucggccugacgucccgcgcgaccugggcccagaacaucccgaccgccauccagcagguccggagccucaucgggaacgaggaguuccuggacuacaugcccuccaugaagcgcuuccggaaggaggaggagagcgagggcgccaucugguga

SEQ ID NO: 9886 - RNA, 9873 nt, Artificial Sequence
  derived and/or modified CDS sequence (opt1) from DENV-3__GU131850__SS-prME
accagccugugccucgugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggucaucuucauccugcugaugcucgugacgcccagcaugaccaugcgcugcgugggggucggcaaccgggacuucguggagggccuguccggggccaccuggguggacgucgugcuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccguccugccggaggagcaggaccagaacuacgugugcaagcacaccuacguggaccgcggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucgugcugaagaaggagguguccgagacccagcacgggaccauccucaucaaggucgaguaccggggcgaggacgcgccgugcaagauccccuucagcaccgaggacgggcagggcaaggcccacaacggccgccugaucacggccaaccccguggugaucaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcgggguccucaacagccugggcaagauggugcaccagaucuucggguccgccuacaccgcccuguucagcggcguguccugggucaugaagaucggcaucgggauccuccugacguggaucggccugaacagcaagaacaccuccaugagcuucuccugcaucgccaucgggaucaucacccucuaccugggcgccguggugcaggcggacaucgggugcgucaucaacuggaagggcaaggagcugaagugcggcagcgggaucuucgugaccaacgaggugcacacguggaccgagcaguacaaguuccaggccgacucccccaagcggcucgccaccgccaucgccggcgcgugggagaacggggucugcggcauccgcagcaccacgcggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagacgugggggaaggccaagaucgugaccgccgagacccagaacagcuccuucaucaucgacggccccaacacccccgagugccccagcgcgucccgggccuggaacgucugggagguggaggacuacggguucggcguguucacgaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcaccuggccgaagucccacacgcucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcaccacgguggucaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucaccaugggcgugcugugccucgcgauccuguucgaggaggucaugcgggggaaguucggcaagaagcacaugaucgccgggguguucuucacguucgugcugcuccuguccggccagaucaccuggcgcgacaugacccacacccugaucaugaucggcagcaacgccuccgaccggauggggaugggcgucacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccauguucacccugaccguggccuggcgcacggccacccugauccucgcgggggucagccugcugccggugugccaguccagcuccaugcgcaagaccgacuggcuccccauggccgucgccgccaugggcgugccgccccucccgcuguucaucuucagccucaaggacacccugaagcggcgcuccuggccccugaacgagggggugauggccgucggccucgugagcauccuggcguccagccugcuccggaacgacgugcccauggccggcccccuggucgccgggggccugcucaucgccugcuacgugaucacggggaccuccgccgaccugaccguggagaaggcggccgacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcguguucccguacagcauccccgccacccugcucguguggcacaccuggcagaagcagacccagcgguccggcguccugugggacgugcccagcccgcccgagacgcagaaggcggagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggcgaucauccgggaggccaucaagcgccggcuccgcacgcugauccuggcccccacccgggucguggccgccgagauggaggaggcgcucaaggggcugcccauccgcuaccagaccaccgccacgaaguccgagcacaccggccgggagaucguggaccugaugugccacgccaccuucaccaugcgccuccugagccccguccgggugccgaacuacaaccugaucaucauggacgaggcccacuucacggaccccgccuccaucgcggcccgcggguacaucagcacccgcgugggcaugggcgaggccgccgcgaucuucaugaccgccacgccgcccgggacggccgacgccuucccgcaguccaacgcccccauccaggacgaggagcgggacauccccgagcgcagcuggaacuccggcaacgaguggaucaccgacuucgucgggaagaccgugugguucgugcccagcaucaaggcgggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagucccggaagacguucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgcuggcuggacgcccggaccuacuccgacccgcuggcccucaaggaguucaaggacuucgccgcgggccgcaagagcaucgcccuggaccuggugacggagaucgggcgggugcccucccaccucgcccaccgcacccggaacgcccuggacaaccuggucaugcuccacaccagcgagcacggcgggcgcgccuaccggcacgcgguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacgcuggccgccaucaucgccgcgaacgagaugggccugcucgagaccaccaagcgggaccugggcauguccaaggagccggggguggugagccccaacuccuaccuggacgucgaccuccaccccgccagcgccuggacccuguacgccguggcgacgaccgugaucacccccaugcugcgccacaccaucgagaacuccacggccaacgucagccucgccgccaucgccaaccaggcgguggugcugaugggccuggacaagggguggccgaucuccaagauggaccucggcgucccccugcuggcccucgggugcuacagccaggugaacccccugacccugaccgccgccgugcuccugcugaucacccacuacgccaucaucggccccggccuccaggcgaaggccacgcgggaggcccagaagcgcaccgccgccgggaucaugaagaacccgaccgucgacggcaucaugaccaucgaccuggaccccgugaucuacgacuccaaguucgagaagcagcugggccaggugaugcuccugguccugugcgcggugcagcuccugcugaugcggacgagcugggcccucugcgaggcccugacccuggccaccggccccaucaccacgcucugggagggcucccccgggaaguucuggaacaccaccaucgcggugagcauggccaacaucuuccgcggcuccuaccuggccggggccggccuggccuucagcaucaugaaguccgucgggaccggcaagcggggcacggggagccagggcgagacccucggggagaaguggaagaagaagcugaaccagcugagccgcaaggaguucgaccucuacaagaaguccggcaucaccgagguggaccggaccgaggcgaaggaggggcugaagaagggcgagaucacccaccacgccgugagccgcggcuccgccaagcugcagugguucgucgagcggaacauggugaucccggaggggcgcgugaucgaccucggcugcgggcggggcggguggagcuacuacugcgccggccugaagaaggucacggaggugcgcggcuacaccaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccacgguggaggagagccgcaccauccggguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacccacgagauguacuggaucuccaacggcacggggaacaucguggccagcgucaacauggugucccgccuccugcugaaccgguucaccaugacccaccgccggccgaccaucgagaaggacguggaccucggcgcgggcacgcgccacgucaacgccgagcccgagacccccaacauggacgugaucggggagcggaucaagcgcaucaaggaggagcacaacagcaccuggcacuacgacgacgagaacccguacaagaccugggccuaccacggcuccuacgaggugaaggccacggggagcgccuccagcaugaucaacggcgucgugaagcugcugaccaagcccugggacgucgugcccauggugacccagauggcgaugaccgacacgacccccuucgggcagcagcgggucuucaaggagaagguggacacccgcaccccgcggagcaugcccggcacgcgccgggugaugggcaucaccgccgaguggcucuggcgcacccuggggcggaacaagaagccccgccugugcacccgcgaggaguucacgaagaagguccggaccaacgccgccaugggcgcgguguucaccgaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacgcggaucaccgaggacgaccugcacaacgaggagaagaucacccagcagauggacccggagcaccgccagcucgccaacgccaucuucaagcugaccuaccagaacaaggucgugaaggugcagcggcccacgcccaccggcaccgucauggacaucaucagccgcaaggaccagcggggcuccggccaggugggcaccuacgggcugaacaccuucacgaacauggaggcccagcucauccgccagauggagggcgagggggugcugagcaaggccgaccuggagaacccccaccucccggagaagaagaucacccaguggcuggagaccaagggcgucgagcggcugaagcgcauggcgaucuccggcgacgacugcguggugaagcccaucgacgaccgguucgccaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggcgggcuggucccuccgcgagaccgccugccugggcaaggccuacgcccagauguggagccugauguacuuccaccggcgcgaccuccggcuggcguccaacgccaucugcagcgccgugcccgugcacugggucccgacgucccgcaccaccuggagcauccacgcccaccaccaguggaugaccacggaggacaugcugaccguguggaaccggguguggaucgaggacaaccccuggauggaggacaagacccccgucaccacgugggagaacgugcccuaccucgggaagcgcgaggaccaguggugcggcagccugaucgggcugaccucccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 9887 - RNA, 9873 nt, Artificial Sequence
  derived and/or modified CDS sequence (opt1) from DENV-3__GU131851__SS-prME
accagccugugccucgugaugauccugcccgccgcccuggcguuccaccucaccagccgggacggggagccgcacaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcgccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacaucggcaccucccucacccagaagguggucaucuucauccugcugaugcucgugacgcccagcaugaccaugcggugcgugggggucggcaaccgcgacuucguggagggccuguccggggccaccuggguggacgucgugcuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccguccugccggaggagcaggaccagaacuacgugugcaagcacaccuacguggaccggggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcaguggcuguucgaccugccccuccccuggaccagcggcgccaccaccgagacgcccaccuggaaccgcaaggagcugcuggucaccuucaagaacgcccacgccaagaagcaggagguggugguccucgggucccaggagggcgcgaugcacaccgcccugacgggggccaccgagauccagaacagcggcgggaccuccaucuucgccggccaccugaagugccggcucaagauggacaagcuggagcugaagggcaugagcuacgccaugugcaccaacacguucgugcucaagaaggagguguccgagacccagcacgggaccauccugaucaaggucgaguaccgcggcgaggacgcgccgugcaagauccccuucagcaccgaggacgggcagggcaaggcccacaacggccggcugaucacggccaaccccguggugaccaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccgcggcgcccggcgcauggccauccucggcgacaccgcgugggacuucggguccgugggcgggguccugaacagccugggcaagauggugcaccagaucuucggguccgccuacacggcccucuucagcggcguguccugggucaugaagaucggcaucgggauccugcugaccuggaucggccucaacagcaagaacaccuccaugagcuucuccugcaucgccaucgggaucaucacccuguaccugggcgccguggugcaggcggacauggggugcgucaucaacuggaagggcaaggagcucaagugcggcagcgggaucuucgugacgaacgaggugcacaccuggaccgagcaguacaaguuccaggccgacucccccaagcgccuggccaccgccaucgccggcgcgugggagaacggggucugcggcauccggagcacgacccgcauggagaaccugcucuggaagcagaucgccaacgagcugaacuacauccugugggagaacaacaucaagcucaccgugguggucggggacaucaucggcgugcuggagcagggcaagcggacccugacgccccagccgauggagcucaaguacuccuggaagaccugggggaaggccaagaucgugaccgccgagacccagaacagcuccuucaucaucgacggccccaacacgcccgagugccccagcgcgucccgcgccuggaacgucugggagguggaggacuacggguucggcguguucaccaccaacaucuggcugaagcugcgggaggucuacacccagcucugcgaccaccgccugaugagcgccgccgugaaggacgagcgggccgugcacgcggacaugggcuacuggaucgagagccagaagaacggguccuggaagcuggagaaggccagccucaucgaggucaagaccugcacguggccgaagucccacacccuguggagcaacggcgugcuggaguccgacaugaucauccccaagagccucgccgggcccaucucccagcacaaccaccgcccgggcuaccacacccagaccgccgggcccuggcaccugggcaagcuggagcucgacuucaacuacugcgagggcacgaccguggucaucaccgagaacugcgggacccggggccccagccugcgcacgaccaccguguccgggaagcugauccacgaguggugcugccggagcugcacccugccgccccugcgcuacaugggcgaggacgggugcugguacggcauggagauccggcccaucuccgagaaggaggagaacauggucaagagccuggucuccgccggcagcgggaagguggacaacuucacgaugggcgugcucugccuggcgauccuguucgaggaggucaugcgcgggaaguucggcaagaagcacaugaucgccgggguguucuucaccuucgugcuccugcuguccggccagaucaccuggcgggacaugacccacacgcucaucaugaucggcagcaacgccuccgaccgcauggggaugggcgucaccuaccuggcccugaucgccaccuucaagauccagcccuuccucgcgcugggguucuuccugcggaagcucaccagccgcgagaaccugcugcucggcgugggccuggccauggccacgacccugcagcuccccgaggacaucgagcagauggccaacgggaucgcgcugggccugauggcccucaagcugaucacccaguucgagaccuaccagcuguggacggcccucaucagccugaccugcuccaacaccauguucacccugacgguggccuggcggaccgccacccucauccuggcgggggucagccugcuccccgugugccaguccagcuccaugcgcaagaccgacuggcugcccauggccgucgccgccaugggcgugccgccccucccccuguucaucuucagccugaaggacacgcugaagcgccgguccuggccccucaacgagggggugauggccgucggccuggugagcauccuggcguccagccuccugcgcaacgacgugcccauggccggcccccuggucgccgggggccuccugaucgccugcuacgugaucaccgggaccuccgccgaccugaccguggagaaggcggccgacaucacgugggaggaggaggccgagcagaccggcgucagccacaaccucaugaucaccguggacgacgacgggaccaugcggaucaaggacgacgagaccgagaacauccugacggugcugcucaagaccgcccugcugaucgucuccggcguguucccguacagcauccccgccacccuccugguguggcacaccuggcagaagcagacgcagcgcuccggcguccugugggacgugcccuccccgcccgagacccagaaggcggagcucgaggaggggguguaccggaucaagcagcagggcaucuucgggaagacccaggucggcgugggggugcagaaggagggcgucuuccacaccauguggcacgugacgcgcggcgccgugcugaccuacaacgggaagcggcuggagcccaacugggccuccgucaagaaggaccucaucagcuacggcgggggcuggcgccuguccgcccaguggcagaagggggaggagguccaggugaucgcggucgagcccggcaagaaccccaagaacuuccagaccaccccgggcacguuccagaccaccaccggggagaucggcgccaucgcccuggacuucaagcccgggacgagcggcagccccaucaucaaccgggagggcaaggugguggggcuguacggcaacggggucgugaccaagaacggcggguacguguccggcaucgcccagaccaacgccgagccggacggccccacccccgagcucgaggaggagauguucaagaagcgcaaccugacgaucauggaccugcaccccgggagcggcaagacccggaaguaccucccggcgaucauccgcgaggccaucaagcggcgccugcggacccugauccucgcccccacccgcgucguggccgccgagauggaggaggcgcugaaggggcugcccauccgguaccagacgaccgccaccaaguccgagcacaccggccgcgagaucguggaccucaugugccacgccacguucaccaugcggcugcugagccccguccgcgugccgaacuacaaccucaucaucauggacgaggcccacuucaccgaccccgccuccaucgcggcccggggguacaucagcacccgcgugggcaugggcgaggccgccgcgaucuucaugacggccacgccgcccgggaccgccgacgccuucccgcaguccaacgcccccauccaggacgaggagcgcgacauccccgagcggagcuggaacuccggcaacgaguggaucaccgacuucgcggggaagacggucugguucgugcccagcaucaaggccggcaacgacaucgccaacugccugcgcaagaacgggaagaaggugauccagcugucccggaagaccuucgacaccgaguaccagaagaccaagcucaacgacugggacuucgucgugacgaccgacaucagcgagaugggcgccaacuucaaggccgaccgcgugaucgacccgcggcgcugccugaagcccgucauccugaccgacggccccgagcgggugauccucgcggggcccaugccggugaccgccgccuccgccgcccagcgccggggccgcgucgggcggaacccccagaaggagaacgaccaguacaucuucaccggccagccccugaacaacgacgaggaccacgcgcacuggacggaggccaagaugcugcucgacaacaucaacacccccgaggggaucaucccggcccuguucgagcccgagcgcgagaaguccgccgcgaucgacggcgaguaccggcugaagggcgagucccgcaagaccuucguggagcucaugcggcgcggggaccugcccguguggcuggcccacaaggucgccagcgagggcaucaaguacaccgaccggaaguggugcuucgacgggcagcgcaacaaccagauccucgaggagaacauggacguggagaucuggacgaaggagggcgagaagaagaagcugcggccccgcuggcuggacgcccgcaccuacuccgacccgcucgcccugaaggaguucaaggacuucgcggccggccgcaagagcaucgcccuggaccucgucaccgagaucgggcgcgugcccucccaccuggcccaccggacccgcaacgcccuggacaaccucgugaugcugcacacgagcgagcacggcgggcgggcguaccgccacgccgucgaggagcugcccgagaccauggagacccuccugcugcucggccugaugauccugcucaccgggggcgccaugcuguuccugaucagcggcaaggggaucggcaagacguccaucgggcucaucugcgugaucgccagcuccggcaugcuguggauggccgagaucccgcugcaguggaucgcgagcgccaucgugcucgaguucuucaugaugguccugcugauccccgagcccgagaagcagcggacgccccaggacaaccagcucgccuacguggugaucgggauccugacccuggccgccaucaucgcggccaacgagaugggccuccuggagaccacgaagcgcgaccugggcauguccaaggagccgggggucgugagccccaccuccuaccucgacguggaccugcaccccgccagcgccuggacccuguacgcggucgccaccacggugaucacccccaugcuccggcacaccaucgagaacuccaccgccaacgugagccuggccgccaucgcgaaccaggccgucgugcugaugggccucgacaagggguggccgaucuccaagauggaccugggcgugccccugcucgcccuggggugcuacagccaggucaacccccugacgcucaccgccgccgugcugcugcucaucacccacuacgcgaucaucggccccggccugcaggccaaggccacccgcgaggcccagaagcggacggccgcggggaucaugaagaacccgaccguggacggcaucaugaccaucgaccuggaccccgucaucuacgacuccaaguucgagaagcagcucggccaggugaugcugcuggugcucugcgccguccagcugcugcucaugcgcaccagcugggcccugugcgaggcccugacgcucgcgaccggccccaucaccacccugugggagggcucccccgggaaguucuggaacacgaccaucgccgugagcauggccaacaucuuccggggcuccuaccuggccggggccggccucgcguucagcaucaugaaguccguggggaccggcaagcgcggcaccgggagccagggcgagacccugggggagaaguggaagaagaagcugaaccagcucagccggaaggaguucgaccuguacaagaaguccggcaucacggaggucgaccgcaccgaggccaaggaggggcugaagcggggcgagaucacccaccacgccgugagccgcggcuccgccaagcuccagugguucguggagcggaacauggucaucccggaggggcgcgugaucgaccugggcugcgggcggggcggguggagcuacuacugcgccggccugaagaaggugaccgagguccgcggcuacacgaagggcgggcccgggcacgaggagcccgugcccauguccaccuacggcuggaacaucgugaagcucaugagcgggaaggacgucuucuaccugccgcccgagaagugcgacacccugcugugcgacaucggcgaguccagccccucccccaccguggaggagagccgcacgauccgggugcucaagauggucgagccguggcugaagaacaaccaguucugcaucaaggugcugaaccccuacaugcccaccgugaucgagcaccucgagcgccugcagcggaagcacggcgggaugcugguccgcaacccccucucccggaacagcacccacgagauguacuggaucuccaacggcaccgggaacaucguggcgagcgugaacauggucucccgccugcugcucaaccgguucacgaugacccaccgccggccgaccaucgagaaggacguggaccugggcgccggcacccgccacgugaacgccgagcccgagacgcccaacauggacgucaucggggagcggaucaagcgcaucaaggaggagcacaacagcaccuggcacuacgacgacgagaacccguacaagaccugggccuaccacggcuccuacgaggugaaggccaccgggagcgcguccagcaugaucaacggcguggucaagcugcucacgaagcccugggacgugguccccauggugacccagauggccaugaccgacaccacgcccuucgggcagcagcggguguucaaggagaaggucgacacccgcaccccgcggagcaugcccggcacccgccgggugauggagaucacggccgaguggcuguggcgcacccugggccggaacaagaagccccgccucugcacccgcgaggaguucaccaagaaggugcggacgaacgccgcgaugggggccgucuucaccgaggagaaccagugggacuccgccaaggccgccguggaggacgaggacuucuggaagcugguggaccgcgagcgggagcugcacaagcucggcaagugcgggagcugcgucuacaacaugaugggcaagcgcgagaagaagcugggggaguucggcaaggcgaagggcucccgggccaucugguacauguggcugggggcccgcuaccucgaguucgaggcccugggcuuccugaacgaggaccacugguucagccgggagaacuccuacagcgggguggagggcgaggggcuccacaagcugggcuacauccugcgcgacaucuccaagauccccggcggggccauguacgcggacgacaccgccggcugggacacccggaucacggaggacgaccuccacaacgaggagaagaucacccagcagauggacccggagcaccgccagcuggccaacgccaucuucaagcugaccuaccagaacaagguggucaaggugcagcggcccacccccaccgggacggugauggacaucaucagccgcaaggaccagcggggcuccggccaggucgggaccuacggccucaacaccuucaccaacauggaggcccagcugauccgccagauggagggggagggcgugcugagcaaggcggaccucgagaacccccaccucccggagaagaagaucacgcaguggcuggagaccaaggggguggagcggcucaagcgcauggccaucuccggcgacgacugcgucgugaagcccaucgacgaccgguucgccaacgcccugcuggcccucaacgacaugggcaaggugcgcaaggacaucccccaguggcagcccagcaagggguggcacgacuggcagcaggucccguucugcucccaccacuuccacgagcugaucaugaaggacggccggaagcugguggugcccugccgcccccaggacgagcucaucgggcgggcgcgcaucagccagggcgccggguggucccugcgcgagaccgccugccugggcaaggccuacgcgcagauguggagccucauguacuuccaccggcgcgaccugcggcuggccuccaacgccaucugcagcgccguccccgugcacugggugccgaccucccgcacgaccuggagcauccacgcccaccaccaguggaugaccaccgaggacaugcucacggucuggaaccggguguggaucgaggacaaccccuggauggaggacaagacccccgugaccaccugggagaacguccccuaccugggcaagcgcgaggaccaguggugcgggagccugaucggccucacgucccgggcgaccugggcccagaacaucccgaccgccauccagcagguccgcagccugaucgggaacgaggaguuccuggacuacaugcccuccaugaagcgguuccgcaaggaggaggagagcgagggcgccaucugguga

SEQ ID NO: 9888 - RNA, 9873 nt, Artificial Sequence
  derived and/or modified CDS sequence (opt1) from DENV-3__GQ868547__SS-prME
accagccucugccucgugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccaggucgagaagguggagacgugggcccugcggcacccgggguucaccauccucgcgcuguuccuggcccacuacaucggcaccucccucacccagaagguggucaucuucauccugcugaugcucgugacgcccagcaugaccaugcgcugcgugggggucggcaaccgggacuucguggagggccuguccggggccaccuggguggacgucgugcuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccguccugccggaggagcaggaccagaacuacgugugcaagcacaccuacguggaccgcggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucgugcugaagaaggagguguccgagacccagcacgggaccauccucaucaaggucgaguaccggggcgaggacgcgccgugcaagauccccuucagcaccgaggacgggcagggcaaggcccacaacggccgccugaucacggccaaccccguggugaccaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcgggguccucaacagccugggcaagauggugcaccagaucuucggguccgccuacacggcccuguucagcggcguguccugggucaugaagaucggcaucgggauccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcggcucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagauggugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgagguccacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacaugacccacacgcugaucaugaucggcagcaacgccuccgaccggauggggaugggcgucaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccauguucacccugacgguggccuggcgcaccgccacccugauccucgcgggggucagccugcugccggugugccaguccagcuccaugcgcaagaccgacuggcuccccauggccgucgccgccaugggcgugccgccccucccgcuguucaucuucagccucaaggacacgcugaagcggcgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugaccguggagaaggcggccgacaucacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcguguucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccacccccggcacguuccagaccaccaccggggagaucggcgccaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucauccgggaggccaucaagcgccggcuccgcacccugauccuggcccccacccgggucguggccgccgagauggaggaggcgcucaaggggcugcccauccgcuaccagacgaccgccaccaaguccgagcacaccggccgggagaucguggaccugaugugccacgccacguucaccaugcgccuccugagccccguccgggugccgaacuacaaccugaucaucauggacgaggcccacuucaccgaccccgccuccaucgcggcccgcggguacaucagcacccgcgugggcaugggcgaggccgccgcgaucuucaugacggccacgccgcccgggaccgccgacgccuucccgcaguccaacgcccccauccaggacgaggagcgggacauccccgagcgcagcuggaacuccggcaacgaguggaucaccgacuucgcggggaagacggucugguucgugcccagcaucaaggccggcaacgacaucgccaacugccuccggaagaacgggaagaaggugauccagcugucccgcaagaccuucgacaccgaguaccagaagaccaagcugaacgacugggacuucgucgugacgaccgacaucagcgagaugggcgccaacuucaaggccgaccgggugaucgacccgcgccggugccucaagcccgucauccugaccgacggccccgagcgcgugauccuggcggggcccaugccggugaccgccgccuccgccgcccagcggcgcggccgggucgggcgcaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgggagaaguccgccgcgaucgacggcgaguaccgccugaagggcgagucccggaagaccuucguggagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggacgaaggagggcgagaagaagaagcuccgcccccgcuggcuggacgcccggaccuacuccgacccgcuggcccucaaggaguucaaggacuucgcggccggccgcaagagcaucgcccuggaccuggucaccgagaucgggcgggugcccucccaccucgcccaccgcacccggaacgcccuggacaaccuggugaugcuccacacgagcgagcacggcgggcgcgcguaccggcacgccgucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucgugcuggaguucuucaugaugguccuccugauccccgagcccgagaagcagcgcacgccccaggacaaccagcuggccuacguggugaucgggauccucacccuggccgccaucaucgcggccaacgagaugggccugcucgagaccacgaagcgggaccugggcauguccaaggagccgggggucgugagccccaccuccuaccuggacguggaccuccaccccgccagcgccuggacccuguacgcggucgccaccacggugaucacccccaugcugcgccacaccaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacgcugaccgccgccgugcuccugcugaucacccacuacgcgaucaucggccccggccuccaggccaaggccacccgggaggcccagaagcgcacggccgcggggaucaugaagaacccgaccguggacggcaucaugaccaucgaccuggaccccgucaucuacgacuccaaguucgagaagcagcugggccaggugaugcuccuggugcugugcgccguccagcuccugcugaugcggaccagcugggcccucugcgaggcccugacgcuggcgaccggccccaucaccacccucugggagggcucccccgggaaguucuggaacacgaccaucgccgugagcauggccaacaucuuccgcggcuccuaccuggccggggccggccuggcguucagcaucaugaaguccguggggaccggcaagcggggcaccgggagccagggcgagacccucggggagaaguggaagaagaagcugaaccagcugagccgcaaggaguucgaccucuacaagaaguccggcaucacggaggucgaccggaccgaggccaaggaggggcugaagcgcggcgagaucacccaccacgccgugagccggggcuccgccaagcugcagugguucguggagcgcaacauggucaucccggaggggcgggugaucgaccucggcugcgggcgcggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccggacgauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugucccgcaacagcacccacgagauguacuggaucuccaacggcaccgggaacaucguggcgagcgugaacauggucucccggcuccugcugaaccgcuucacgaugacccaccggcgcccgaccaucgagaaggacguggaccucggcgccggcacccggcacgugaacgccgagcccgagacgcccaacauggacgucaucggggagcgcaucaagcggaucaaggaggagcacaacagcaccuggcacuacgacgacgagaacccguacaagaccugggccuaccacggcuccuacgaggugaaggccaccgggagcgcguccagcaugaucaacggcguggucaagcugcugacgaagcccugggacgugguccccauggugacccagauggccaugaccgacaccacgcccuucgggcagcagcgcguguucaaggagaaggucgacacccggaccccgcgcagcaugcccggcacccggcgcgugauggagaucacggccgaguggcucuggcggacccugggccgcaacaagaagccccgccugugcacccgggaggaguucaccaagaaggugcgcacgaacgccgcgaugggggccgucuucaccgaggagaaccagugggacuccgccaaggccgccguggaggacgaggacuucuggaagcucguggaccgggagcgcgagcugcacaagcugggcaagugcgggagcugcgucuacaacaugaugggcaagcgggagaagaagcucggggaguucggcaaggcgaagggcucccgcgccaucugguacauguggcugggggcccgguaccuggaguucgaggcccucggcuuccugaacgaggaccacugguucagccgcgagaacuccuacagcgggguggagggcgaggggcugcacaagcucggcuacauccugcgggacaucuccaagauccccggcggggccauguacgcggacgacaccgccggcugggacacccgcaucacggaggacgaccugcacaacgaggagaagaucacccagcagauggacccggagcaccggcagcucgccaacgccaucuucaagcugaccuaccagaacaagguggucaaggugcagcgccccacccccaccgggacggugauggacaucaucagccggaaggaccagcgcggcuccggccaggucgggaccuacggccugaacaccuucaccaacauggaggcccagcucauccggcagauggagggggagggcgugcugagcaaggcggaccuggagaacccccaccucccggagaagaagaucacgcaguggcuggagaccaaggggguggagcgccugaagcggauggccaucuccggcgacgacugcgucgugaagcccaucgacgaccgcuucgccaacgcccuccuggcccugaacgacaugggcaaggugcggaaggacaucccccaguggcagcccagcaagggguggcacgacuggcagcaggucccguucugcucccaccacuuccacgagcucaucaugaaggacggccgcaagcugguggugcccugccggccccaggacgagcugaucgggcgcgcgcgcaucagccagggcgccggguggucccuccgggagaccgccugccugggcaaggccuacgcgcagauguggagccugauguacuuccaccgccgggaccuccgccuggccuccaacgccaucugcagcgccguccccgugcacugggugccgaccucccggacgaccuggagcauccacgcccaccaccaguggaugaccaccgaggacaugcugacggucuggaaccgcguguggaucgaggacaaccccuggauggaggacaagacccccgugaccaccugggagaacguccccuaccucggcaagcgggaggaccaguggugcgggagccugaucggccugacgucccgcgcgaccugggcccagaacaucccgaccgccauccagcagguccggagccucaucgggaacgaggaguuccuggacuacaugcccuccaugaagcgcuuccggaaggaggaggagagcgagggcgccaucugguga

SEQ ID NO: 9889 - RNA, 9873 nt, Artificial Sequence
  derived and/or modified CDS sequence (opt1) from DENV-3__GU131857__SS-prME
accagccucugccucgugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggucaucuucauccugcugaugcucgugacgcccagcaugaccaugcgcugcgugggggucggcaaccgggacuucguggagggccuguccggggccaccuggguggacgucgugcuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccguccugccggaggagcaggaccagaacuacgugugcaagcacaccuacguggaccgcggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucgugcugaagaaggagguguccgagacccagcacgggaccauccucaucaaggucgaguaccggggcgaggacgcgccgugcaagauccccuucagcaccgaggacgggcagggcaaggcccacaacggccgccugaucacggccaaccccguggugaccaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcgggguccucaacagccugggcaagauggugcaccagaucuucggguccgccuacacggcccuguucagcggcguguccugggucaugaagaucggcaucgggauccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcggcucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacaugacccacacgcugaucaugaucggcagcaacgccuccgaccggauggggaugggcgucaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccauguucacccugacgguggccuggcgcaccgccacccugauccucgcgggggucagccugcugccggugugccaguccagcuccaugcgcaagaccgacuggcuccccauggccgucgccgccaugggcgugccgccccucccgcuguucaucuucagccucaaggacacgcugaagcggcgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugaccguggagaaggcggccgacaucacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcguguucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccacccccggcacguuccagaccaccaccggggagaucggcgccaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucauccgggaggccaucaagcgccggcuccgcacccugauccuggcccccacccgggucguggccgccgagauggaggaggcgcucaaggggcugcccauccgcuaccagacgaccgccaccaaguccgagcacaccggccgggagaucguggaccugaugugccacgccacguucaccaugcgccuccugagccccguccgggugccgaacuacaaccugaucaucauggacgaggcccacuucaccgaccccgccuccaucgcggcccgcggguacaucagcacccgcgugggcaugggcgaggccgccgcgaucuucaugacggccacgccgcccgggaccgccgacgccuucccgcaguccaacgcccccauccaggacgaggagcgggacauccccgagcgcagcuggaacuccggcaacgaguggaucaccgacuucgucgggaagacggugugguucgugcccagcaucaaggcgggcaacgacaucgccaacugccuccggaagaacgggaagaaggucauccagcugucccgcaagaccuucgacaccgaguaccagaagaccaagcugaacgacugggacuucguggugacgaccgacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggacgaaggagggcgagaagaagaagcuccgcccccgcuggcuggacgcccggaccuacuccgacccgcuggcccucaaggaguucaaggacuucgccgcgggccgcaagagcaucgcccuggaccuggugaccgagaucgggcgggugcccucccaccucgcccaccgcacccggaacgcccuggacaaccuggucaugcuccacacgagcgagcacggcgggcgcgccuaccggcacgcgguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagaccacgaagcgggaccugggcauguccaaggagccggggguggugagccccaccuccuaccuggacgucgaccuccaccccgccagcgccuggacccuguacgccguggcgaccacggugaucacccccaugcugcgccacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacgcugaccgccgccgugcuccugcugaucacccacuacgccaucaucggccccggccuccaggcgaaggccacccgggaggcccagaagcgcacggccgccgggaucaugaagaacccgaccgucgacggcaucaugaccaucgaccuggaccccgugaucuacgacuccaaguucgagaagcagcugggccaggugaugcuccugguccugugcgcggugcagcuccugcugaugcggaccagcugggcccucugcgaggcccugacgcuggccaccggccccaucaccacccucugggagggcucccccgggaaguucuggaacacgaccaucgcggugagcauggccaacaucuuccgcggcuccuaccuggccggggccggccuggccuucagcaucaugaaguccgucgggaccggcaagcggggcaccgggagccagggcgagacccucggggagaaguggaagaagaagcugaaccagcugagccgcaaggaguucgaccucuacaagaaguccggcaucacggagguggaccggaccgaggcgaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcgcggcuacacgaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccaccguggaggagagccggacgauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacccacgagauguacuggaucuccaacggcaccgggaacaucguggccagcgucaacauggugucccggcuccugcugaaccgcuucacgaugacccaccggcgcccgaccaucgagaaggacguggaccucggcgcgggcacccggcacgucaacgccgagcccgagacgcccaacauggacgugaucggggagcgcaucaagcggaucaaggaggagcacaacagcaccuggcacuacgacgacgagaacccguacaagaccugggccuaccacggcuccuacgaggugaaggccaccgggagcgccuccagcaugaucaacggcgucgugaagcugcugacgaagcccugggacgucgugcccauggugacccagauggcgaugaccgacaccacgcccuucgggcagcagcgcgucuucaaggagaagguggacacccggaccccgcgcagcaugcccggcacccggcgcgugauggagaucacggccgaguggcucuggcggacccugggccgcaacaagaagccccgccugugcacccgggaggaguucaccaagaagguccgcacgaacgccgccaugggggcgguguucaccgaggagaaccagugggacuccgccaaggccgccguggaggacgaggacuucuggaagcucgucgaccgggagcgcgagcugcacaagcugggcaagugcgggagcugcguguacaacaugaugggcaagcgggagaagaagcucggggaguucggcaaggccaagggcucccgcgcgaucugguacauguggcugggggcccgguaccuggaguucgaggcccucggcuuccugaacgaggaccacugguucagccgcgagaacuccuacagcgggguggagggcgaggggcugcacaagcucggcuacauccugcgggacaucuccaagauccccggcggggccauguacgccgacgacaccgcgggcugggacacccgcaucacggaggacgaccugcacaacgaggagaagaucacccagcagauggacccggagcaccggcagcucgccaacgccaucuucaagcugaccuaccagaacaaggucgugaaggugcagcgccccacccccaccgggacggucauggacaucaucagccggaaggaccagcgcggcuccggccagguggggaccuacggccugaacaccuucaccaacauggaggcccagcucauccggcagauggagggggagggcgugcugagcaaggccgaccuggagaacccccaccucccggagaagaagaucacgcaguggcuggagaccaagggggucgagcgccugaagcggauggcgaucuccggcgacgacugcguggugaagcccaucgacgaccgcuucgccaacgcccuccuggcccugaacgacaugggcaagguccggaaggacaucccccaguggcagcccagcaagggguggcacgacuggcagcaggucccguucugcucccaccacuuccacgagcucaucaugaaggacggccgcaagcuggugguccccugccggccccaggacgagcugaucgggcgcgcccgcaucagccagggcgcgggguggucccuccgggagaccgccugccugggcaaggccuacgcccagauguggagccugauguacuuccaccgccgggaccuccgccuggcguccaacgccaucugcagcgccgugcccgugcacugggucccgaccucccggacgaccuggagcauccacgcccaccaccaguggaugaccaccgaggacaugcugacgguguggaaccgcguguggaucgaggacaaccccuggauggaggacaagacccccgucaccaccugggagaacgugcccuaccucggcaagcgggaggaccaguggugcgggagccugaucggccugacgucccgcgccaccugggcgcagaacaucccgaccgccauccagcagguccggagccucaucgggaacgaggaguuccuggacuacaugcccuccaugaagcgcuuccggaaggaggaggagagcgagggcgccaucugguga

SEQ ID NO: 9890 - RNA, 9873 nt, Artificial Sequence
  derived and/or modified CDS sequence (opt1) from DENV-3__GU131858__SS-prME
accagccucugccucgugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccaggucgagaagguggagacgugggcccugcggcacccgggguucaccauccucgcgcuguuccuggcccacuacaucggcaccucccucacccagaagguggucaucuucauccugcugaugcucgugacgcccagcaugaccaugcgcugcgugggggucggcaaccgggacuucguggagggccuguccggggccaccuggguggacgucgugcuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccguccugccggaggagcaggaccagaacuacgugugcaagcacaccuacguggaccgcggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucgugcugaagaaggagguguccgagacccagcacgggaccauccucaucaaggucgaguaccggggcgaggacgcgccgugcaagauccccuucagcaccgaggacgggcagggcaaggcccacaacggccgccugaucacggccaaccccguggugaucaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcgggguccucaacagccugggcaagauggugcaccagaucuucggguccgccuacaccgcccuguucagcggcguguccugggucaugaagaucggcaucgggauccuccugacguggaucggccugaacagcaagaacaccuccaugagcuucuccugcaucgccaucgggaucaucacccucuaccugggcgccguggugcaggcggacaucgggugcgucaucaacuggaagggcaaggagcugaagugcggcagcgggaucuucgugaccaacgaggugcacacguggaccgagcaguacaaguuccaggccgacucccccaagcggcucgccaccgccaucgccggcgcgugggagaacggggucugcggcauccgcagcaccacgcggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagacgugggggaaggccaagaucgugaccgccgagacccagaacagcuccuucaucaucgacggccccaacacccccgagugccccagcgcgucccgggccuggaacgucugggagguggaggacuacggguucggcguguucacgaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcaccuggccgaagucccacacgcucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcaccacgguggucaucaccgagaacugcgggaccagcggccccucccucaccacgaccaccgugagcgggaagcugauccacgaguggugcugccgcuccugcacccugcccccgcuccgguacaugggcgaggacgggugcugguacggcauggagauccgccccaucagcgagaaggaggagaacauggugaagucccuggucagcgccggcuccgggaagguggacaacuucacgaugggcgugcugugccucgcgauccuguucgaggaggucaugcgggggaaguucggcaagaagcacaugaucgccgggguguucuucaccuucgugcugcuccugagcggccagaucaccuggcgcgacaugacccacacgcugaucaugaucggcuccaacgccagcgaccggauggggaugggcgucaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucucccugaccugcagcaacaccauguucacccugacgguggccuggcgcaccgccacccugauccucgcgggggucucccugcugccggugugccagagcuccagcaugcggaagaccgacuggcuccccauggccgucgccgccaugggcgugccgccccucccgcuguucaucuucucccucaaggacacgcugaagcgccgcagcuggccccugaacgagggggugauggccgucggccucguguccauccuggcgagcucccugcuccggaacgacgugcccauggccggcccccuggucgccgggggccugcucaucgccugcuacgugaucaccgggaccagcgccgaccugaccguggagaaggcggccgacaucacgugggaggaggaggccgagcagaccggcgucucccacaaccugaugaucaccguggacgacgacgggaccaugcgcaucaaggacgacgagaccgagaacauccucacggugcugcugaagaccgcccuccugaucgucagcggcguguucccguacuccauccccgccacccugcucguguggcacaccuggcagaagcagacgcagcggagcggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccagcgucaagaaggaccugaucuccuacggcgggggcuggcggcucagcgcccaguggcagaagggggaggagguccaggugaucgcggucgagcccggcaagaaccccaagaacuuccagaccaugcccggcaccuuccagacgaccaccggggagaucggcgccaucgcccuggacuucaagcccgggaccagcggcucccccaucaucaaccgcgagggcaaggugguggggcuguacggcaacggggucgugacgaagaacggcggguacgugagcggcaucgcccagaccaacgccgagccggacggccccacccccgagcuggaggaggagauguucaagaagcggaaccucaccaucauggaccugcaccccggguccggcaagacgcgcaaguaccugccggcgaucauccgggaggccaucaagcgccggcuccgcacccugauccuggcccccacccgggucguggccgccgagauggaggaggcgcucaaggggcugcccauccgcuaccagaccacggccaccaagagcgagcacaccggccgggagaucguggaccugaugugccacgccaccuucacgaugcgccuccugucccccguccgggugccgaacuacaaccugaucaucauggacgaggcccacuucaccgaccccgccagcaucgcggcccgcggguacaucuccacccgggugggcaugggcgaggccgccgcgaucuucaugaccgccacgccgcccgggaccgccgacgccuucccgcagagcaacgcccccauccaggacgaggagcgcgacauccccgagcgcuccuggaacagcggcaacgaguggaucaccgacuucgucgggaagaccgugugguucgugcccuccaucaaggcgggcaacgacaucgccaacugccuccggaagaacgggaagaaggucauccagcugagccgcaagacguucgacaccgaguaccagaagaccaagcugaacgacugggacuucguggugaccacggacaucuccgagaugggcgccaacuucaaggccgaccgggucaucgacccgcgccggugccucaagcccgugauccugaccgacggccccgagcgcgugauccuggccgggcccaugccggucaccgcggccagcgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagagccggaagaccuucguggagcugaugcgccgcggggaccuccccgucuggcuggcgcacaagguggccuccgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacagcgacccgcuggcccucaaggaguucaaggacuucgccgcgggccgcaaguccaucgcccuggaccuggugaccgagaucgggcgggugcccagccaccucgcccaccgcacccggaacgcccuggacaaccuggucaugcuccacaccagcgagcacggcgggcgcgccuaccggcacgcgguggaggagcugcccgagacgauggagacccugcuccugcugggccucaugauccugcugaccgggggcgccaugcuguuccugaucuccggcaaggggaucggcaagaccagcaucgggcugaucugcgugaucgccuccagcggcaugcucuggauggccgagaucccgcugcaguggaucgccuccgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagaccaccaagcgggaccugggcaugagcaaggagccggggguggugucccccaacagcuaccuggacgucgaccuccaccccgccuccgccuggacgcuguacgccguggcgaccaccgugaucacccccaugcugcgccacacgaucgagaacagcaccgccaacgucucccucgccgccaucgccaaccaggcgguggugcugaugggccuggacaagggguggccgaucagcaagauggaccucggcgucccccugcuggcccucgggugcuacucccaggugaacccccugacccugaccgccgccgugcuccugcugaucacgcacuacgccaucaucggccccggccuccaggcgaaggccacccgggaggcccagaagcgcaccgccgccgggaucaugaagaacccgaccgucgacggcaucaugacgaucgaccuggaccccgugaucuacgacagcaaguucgagaagcagcugggccaggugaugcuccugguccugugcgcggugcagcuccugcugaugcggaccuccugggcccucugcgaggcccugacccuggccaccggccccaucacgacccucugggagggcagccccgggaaguucuggaacaccaccaucgcgguguccauggccaacaucuuccgcggcagcuaccuggccggggccggccuggccuucuccaucaugaaguccgucgggacgggcaagcggggcaccgggagccagggcgagacccucggggagaaguggaagaagaagcugaaccagcugucccgcaaggaguucgaccucuacaagaaguccggcaucaccgagguggaccggaccgaggcgaaggaggggcugaagcgcggcgagaucacgcaccacgccgugucccggggcagcgccaagcugcagugguucgucgagcgcaacauggugaucccggaggggcgggugaucgaccucggcugcgggcgcggcgggugguccuacuacugcgccggccugaagaaggucaccgaggugcggggcuacaccaagggcgggcccgggcacgaggagcccgugcccaugagcaccuacggcuggaacaucgucaagcugauguccgggaaggacguguucuaccucccgcccgagaagugcgacacgcugcugugcgacaucggcgagagcucccccagccccaccguggaggagucccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugagccgcaacuccacgcacgagauguacuggaucagcaacggcaccgggaacaucguggccuccgucaacauggugagccggcuccugcugaaccgcuucaccaugacccaccggcgcccgacgaucgagaaggacguggaccucggcgcgggcacccggcacgucaacgccgagcccgagacccccaacauggacgugaucggggagcgcaucaagcggaucaaggaggagcacaacuccaccuggcacuacgacgacgagaacccguacaagacgugggccuaccacggcagcuacgaggugaaggccaccggguccgccagcagcaugaucaacggcgucgugaagcugcugaccaagcccugggacgucgugcccauggugacccagauggcgaugacggacaccacccccuucgggcagcagcgcgucuucaaggagaagguggacacccggacgccgcgcuccaugcccggcacccggcgcgugaugggcaucaccgccgaguggcucuggcggacccuggggcgcaacaagaagccccggcugugcacgcgcgaggaguucaccaagaagguccgcaccaacgccgccaugggcgcgguguucaccgaggagaaccagugggacagcgccaaggccgccguggaggacgaggacuucuggaagcucgucgaccgggagcgcgagcugcacaagcuggggaagugcggcuccugcguguacaacaugauggggaagcgggagaagaagcucggcgaguucggcaaggccaaggggagccgcgcgaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgccauguacgccgacgacacggcggggugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucucccggaaggaccagcgcggcagcggccaggugggcaccuacgggcugaacacguucaccaacauggaggcccagcucauccggcagauggagggcgagggggugcuguccaaggccgaccuggagaacccccaccucccggagaagaagaucacccaguggcuggagaccaagggcgucgagcgccugaagcggauggcgaucagcggcgacgacugcguggugaagcccaucgacgaccgcuucgccaacgcccuccuggcccugaacgacauggggaagguccggaaggacaucccccaguggcagcccuccaagggcuggcacgacuggcagcaggucccguucugcagccaccacuuccacgagcucaucaugaaggacgggcgcaagcuggugguccccugccggccccaggacgagcugaucggccgcgcccggaucucccagggggcgggcuggagccuccgcgagacggccugccugggcaaggccuacgcccagauguggucccugauguacuuccaccgccgggaccuccgccuggcgagcaacgccaucugcuccgccgugcccgugcacugggucccgaccagccggaccaccuggagcauccacgcccaccaccaguggaugacgaccgaggacaugcugaccguguggaaccgcguguggaucgaggacaaccccuggauggaggacaagacccccgucacgaccugggagaacgugcccuaccucgggaagcgggaggaccaguggugcggcucccugaucgggcugaccagccgcgccaccugggcgcagaacaucccgacggccauccagcagguccggucccucaucggcaacgaggaguuccuggacuacaugcccagcaugaagcgcuuccggaaggaggaggaguccgagggggccaucugguga

SEQ ID NO: 9891 - RNA, 9873 nt, Artificial Sequence
  derived and/or modified CDS sequence (opt1) from DENV-3__GQ868548__SS-prME
accagccucugccucgugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggucaucuucauccugcugaugcucgugacgcccagcaugaccaugcgcugcgugggggucggcaaccgggacuucguggagggccuguccggggccaccuggguggacgucgugcuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccguccugccggaggagcaggaccagaacuacgugugcaagcacaccuacguggaccgcggguggggcaacgggugcggccucuucgggaagggcucccuggugaccugcgccaaguuccagugccuggagcccaucgagggcaagguggugcagcacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucgugcugaagaaggagguguccgagacccagcacgggaccauccucaucaaggucgaguaccggggcgaggacgcgccgugcaagauccccuucagcaccgaggacgggcagggcaaggcccacaacggccgccugaucacggccaaccccguggugaccaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcgggguccucaacagccugggcaagauggugcaccagaucuucggguccgccuacacggcccuguucagcggcguguccugggucaugaagaucggcaucgggauccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcggcucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacaugacccacacgcugaucaugaucggcagcaacgccuccgaccggauggggaugggcgucaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccauguucacccugacgguggccuggcgcaccgccacccugauccucgcgggggucagccugcugccggugugccaguccagcuccaugcgcaagaccgacuggcuccccauggccgucgccgccaugggcgugccgccccucccgcuguucaucuucagccucaaggacacgcugaagcggcgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugaccguggagaaggcggccgacaucacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcguguucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccacccccggcacguuccagaccaccaccggggagaucggcgccaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucauccgggaggccaucaagcgccggcuccgcacccugauccuggcccccacccgggucguggccgccgagauggaggaggcgcucaaggggcugcccauccgcuaccagacgaccgccaccaaguccgagcacaccggccgggagaucguggaccugaugugccacgccacguucaccaugcgccuccugagccccguccgggugccgaacuacaaccugaucaucauggacgaggcccacuucaccgaccccgccuccaucgcggcccgcggguacaucagcacccgcgugggcaugggcgaggccgccgcgaucuucaugacggccacgccgcccgggaccgccgacgccuucccgcaguccaacgcccccauccaggacgaggagcgggacauccccgagcgcagcuggaacuccggcaacgaguggaucaccgacuucgucgggaagacggugugguucgugcccagcaucaaggcgggcaacgacaucgccaacugccuccggaagaacgggaagaaggucauccagcugucccgcaagaccuucgacaccgaguaccagaagaccaagcugaacgacugggacuucguggugacgaccgacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggacgaaggagggcgagaagaagaagcuccgcccccgcuggcuggacgcccggaccuacuccgacccgcuggcccucaaggaguucaaggacuucgccgcgggccgcaagagcaucgcccuggaccuggugaccgagaucgggcgggugcccucccaccucgcccaccgcacccggaacgcccuggacaaccuggucaugcuccacacgagcgagcacggcgggcgcgccuaccggcacgcgguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagaccacgaagcgggaccugggcauguccaaggagccggggguggugagccccaccuccuaccuggacgucgaccuccaccccgccagcgccuggacccuguacgccguggcgaccacggugaucacccccaugcugcgccacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacgcugaccgccgccgugcuccugcugaucacccacuacgccaucaucggccccggccuccaggcgaaggccacccgggaggcccagaagcgcacggccgccgggaucaugaagaacccgaccgucgacggcaucaugaccaucgaccuggaccccgugaucuacgacuccaaguucgagaagcagcugggccaggugaugcuccugguccugugcgcggugcagcuccugcugaugcggaccagcugggcccucugcgaggcccugacgcuggccaccggccccaucaccacccucugggagggcucccccgggaaguucuggaacacgaccaucgcggugagcauggccaacaucuuccgcggcuccuaccuggccggggccggccuggccuucagcaucaugaaguccgucgggaccggcaagcggggcaccgggagccagggcgagacccucggggagaaguggaagaagaagcugaaccagcugagccgcaaggaguucgaccucuacaagaaguccggcaucacggagguggaccggaccgaggcgaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcgcggcuacacgaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccaccguggaggagagccggacgauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacccacgagauguacuggaucuccaacggcaccgggaacaucguggccagcgucaacauggugucccggcuccugcugaaccgcuucacgaugacccaccggcgcccgaccaucgagaaggacguggaccucggcgcgggcacccggcacgucaacgccgagcccgagacgcccaacauggacgugaucggggagcgcaucaagcggaucaaggaggagcacaacagcaccuggcacuacgacgacgagaacccguacaagaccugggccuaccacggcuccuacgaggugaaggccaccgggagcgccuccagcaugaucaacggcgucgugaagcugcugacgaagcccugggacgucgugcccauggugacccagauggcgaugaccgacaccacgcccuucgggcagcagcgcgucuucaaggagaagguggacacccggaccccgcgcagcaugcccggcacccggcgcgugauggagaucacggccgaguggcucuggcggacccugggccgcaacaagaagccccgccugugcacccgggaggaguucaccaagaagguccgcacgaacgccgccaugggggcgguguucaccgaggagaaccagugggacuccgccaaggccgccguggaggacgaggacuucuggaagcucgucgaccgggagcgcgagcugcacaagcugggcaagugcgggagcugcguguacaacaugaugggcaagcgggagaagaagcucggggaguucggcaaggccaagggcucccgcgcgaucugguacauguggcugggggcccgguaccuggaguucgaggcccucggcuuccugaacgaggaccacugguucagccgcgagaacuccuacagcgggguggagggcgaggggcugcacaagcucggcuacauccugcgggacaucuccaagauccccggcggggccauguacgccgacgacaccgcgggcugggacacccgcaucacggaggacgaccugcacaacgaggagaagaucacccagcagauggacccggagcaccggcagcucgccaacgccaucuucaagcugaccuaccagaacaaggucgugaaggugcagcgccccacccccaccgggacggucauggacaucaucagccggaaggaccagcgcggcuccggccagguggggaccuacggccugaacaccuucaccaacauggaggcccagcucauccggcagauggagggggagggcgugcugagcaaggccgaccuggagaacccccaccucccggagaagaagaucacgcaguggcuggagaccaagggggucgagcgccugaagcggauggcgaucuccggcgacgacugcguggugaagcccaucgacgaccgcuucgccaacgcccuccuggcccugaacgacaugggcaagguccggaaggacaucccccaguggcagcccagcaagggguggcacgacuggcagcaggucccguucugcucccaccacuuccacgagcucaucaugaaggacggccgcaagcuggugguccccugccggccccaggacgagcugaucgggcgcgcccgcaucagccagggcgcgggguggucccuccgggagaccgccugccugggcaaggccuacgcccagauguggagccugauguacuuccaccgccgggaccuccgccuggcguccaacgccaucugcagcgccgugcccgugcacugggucccgaccucccggacgaccuggagcauccacgcccaccaccaguggaugaccaccgaggacaugcugacgguguggaaccgcguguggaucgaggacaaccccuggauggaggacaagacccccgucaccaccugggagaacgugcccuaccucggcaagcgggaggaccaguggugcgggagccugaucggccugacgucccgcgccaccugggcgcagaacaucccgaccgccauccagcagguccggagccucaucgggaacgaggaguuccuggacuacaugcccuccaugaagcgcuuccggaaggaggaggagagcgagggcgccaucugguga

SEQ ID NO: 9892 - RNA, 9873 nt, Artificial Sequence
  derived and/or modified CDS sequence (opt1) from DENV-3__GU131861__SS-prME
accagccucugccucgugaugauccugcccgccgcccuggcguuccaccucaccagccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccaggucgagaagguggagacgugggcccugcggcacccgggguucaccauccucgcgcuguuccuggcccacuacaucggcaccucccucacccagaagguggucaucuucauccugcugaugcucgugacgcccagcaugaccaugcgcugcgugggggucggcaaccgggacuucguggagggccuguccggggccaccuggguggacgucgugcuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccguccugccggaggagcaggaccagaacuacgugugcaagcacaccuacguggaccgcggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucgugcugaagaaggagguguccgagacccagcacgggaccauccucaucaaggucgaguaccggggcgaggacgcgccgugcaagauccccuucagcaccgaggacgggcagggcaaggcccacaacggccgccugaucacggccaaccccguggugaccaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcgggguccucaacagccugggcaagauggugcaccagaucuucggguccgccuacacggcccuguucagcggcguguccugggucaugaagaucggcaucgggauccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcggcucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacaugacccacacgcugaucaugaucggcagcaacgccuccgaccggauggggaugggcgucaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccauguucacccugacgguggccuggcgcaccgccacccugauccucgcgggggucagccugcugccggugugccaguccagcuccaugcgcaagaccgacuggcuccccauggccgucgccgccaugggcgugccgccccucccgcuguucaucuucagccucaaggacacgcugaagcggcgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugaccguggagaaggcggccgacaucacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcguguucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccacccccggcacguuccagaccaccaccggggagaucggcgccaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucauccgggaggccaucaagcgccggcuccgcacccugauccuggcccccacccgggucguggccgccgagauggaggaggcgcucaaggggcugcccauccgcuaccagacgaccgugaccaaguccgagcacaccggccgggagaucgucgaccugaugugccacgccacguucaccaugcgccuccugagccccgugcgggugccgaacuacaaccugaucaucauggacgaggcccacuucaccgaccccgccuccaucgccgcgcgcggguacaucagcacccgcgucggcaugggcgaggccgccgccaucuucaugacggcgacgccgcccgggaccgccgacgccuucccgcaguccaacgcccccauccaggacgaggagcgggacauccccgagcgcagcuggaacuccggcaacgaguggaucaccgacuucgccgggaagacggugugguucgugcccagcaucaaggcgggcaacgacaucgccaacugccuccggaagaacgggaagaaggucauccagcugucccgcaagaccuucgacaccgaguaccagaagaccaagcugaacgacugggacuucguggugacgaccgacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggacgaaggagggcgagaagaagaagcuccgcccccgcuggcuggacgcccggaccuacuccgacccgcuggcccucaaggaguucaaggacuucgccgcgggccgcaagagcaucgcccuggaccuggugaccgagaucgggcgggugcccucccaccucgcccaccgcacccggaacgcccuggacaaccuggucaugcuccacacgagcgagcacggcgggcgcgccuaccggcacgcgguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgccagcgcggucgugcuggaguucuucaugauggugcuccugauccccgagcccgagaagcagcgcacgccccaggacaaccagcuggccuacgucgugaucgggauccucacccuggccgccaucaucgccgcgaacgagaugggccugcucgagaccacgaagcgggaccugggcauguccaaggagccggggguggucagccccaccuccuaccuggacguggaccuccaccccgccagcgccuggacccuguacgccguggcgaccacggucaucacccccaugcugcgccacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacgcugaccgccgccguccuccugcugaucacccacuacgccaucaucggccccggccuccaggcgaaggccacccgggaggcccagaagcgcacggccgccgggaucaugaagaacccgaccguggacggcaucaugaccaucgaccuggaccccgugaucuacgacuccaaguucgagaagcagcuggggcaggucaugcuccuggugcugugcgcggugcagcuccugcugaugcggaccagcugggcccucugcgaggcccugacgcuggccaccggccccaucaccacccucugggagggcucccccgggaaguucuggaacacgaccaucgcggucagcauggccaacaucuuccgcggcuccuaccuggccggggccggccuggccuucagcaucaugaaguccguggggaccggcaagcggggcaccgggagccagggcgagacccucggggagaaguggaagcgcaagcugaaccagcugagccggaaggaguucgaccucuacaagaaguccggcaucacggagguggaccgcaccgaggcgaaggaggggcugaagcggggcgagaucacccaccacgccgucagccgcggcuccgccaagcugcagugguucguggagcggaacauggugaucccggaggggcgcgucaucgaccucggcugcgggcgcggcggguggagcuacuacugcgccggccugaagaaggugaccgaggugcggggcuacacgaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccaccgucgaggagagccgcacgauccgggugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucacgaugacccaccgccggccgaccaucgagaaggacgucgaccucggcgcgggcacccgccacgugaacgccgagcccgagacgcccaacauggacgugaucggggagcggaucaagaagaucaaggaggagcacaacagcaccuggcacuacgacgacgagaacccguacaagaccugggccuaccacggcuccuacgaggucaaggccaccgggagcgccuccagcaugaucaacggcguggucaagcugcugacgaagcccugggacguggugcccauggucacccagauggcgaugaccgacaccacgcccuucgggcagcagcgcguguucaaggagaagguggacacccggaccccgcgcagcaugcccggcacccggcgcgucauggagaucacggccgaguggcucuggcggacccugggccgcaacaagaagccccgccugugcacccgggaggaguucaccaagaaggugcgcacgaacgccgccaugggggcgguguucaccgaggagaaccagugggacuccgccaaggccgccgucgaggacgaggacuucuggaagcucguggaccgggagcgcgagcugcacaagcugggcaagugcgggagcugcguguacaacaugaugggcaagcgggagaagaagcucggggaguucggcaaggccaagggcucccgcgcgaucugguacauguggcugggggcccgguaccuggaguucgaggcccucggcuuccugaacgaggaccacugguucagccgcgagaacuccuacagcggggucgagggcgaggggcugcacaagcucggcuacauccugcgggacaucuccaagauccccggcggggccauguacgccgacgacaccgcgggcugggacacccgcaucacggaggacgaccugcacaacgaggagaagaucacccagcagauggacccggagcaccggcagcucgccaacgccaucuucaagcugaccuaccagaacaagguggugaagguccagcgccccacccccaccgggacggugauggacaucaucagccggaaggaccagcgcggcuccggccagguggggaccuacggccugaacaccuucaccaacauggaggcccagcucauccggcagauggagggggagggcguccugagcaaggccgaccuggagaacccccaccucccggagaagaagaucacgcaguggcuggagaccaaggggguggagcgccugaagcggauggcgaucuccggcgacgacugcguggucaagcccaucgacgaccgcuucgccaacgcccuccuggcccugaacgacaugggcaaggugcggaaggacaucccccaguggcagcccagcaagggguggcacgacuggcagcaggucccguucugcucccaccacuuccacgagcucaucaugaaggacggccgcaagcuggucgugcccugccggccccaggacgagcugaucgggcgcgcccgcaucagccagggcgcgggguggucccuccgggagaccgccugccugggcaaggccuacgcccagauguggagccugauguacuuccaccgccgggaccuccgccuggcguccaacgccaucugcagcgccgugcccguccacugggugccgaccucccggacgaccuggagcauccacgcccaccaccaguggaugaccaccgaggacaugcugacgguguggaaccgcgucuggaucgaggacaaccccuggauggaggacaagacccccgugaccaccugggagaacgugcccuaccucggcaagcgggaggaccaguggugcgggagccugaucggccugacgucccgcgccaccugggcgcagaacaucccgaccgccauccagcagguccggagccucaucgggaacgaggaguuccuggacuacaugcccuccaugaagcgcuuccggaaggaggaggagagcgagggcgccaucugguga

SEQ ID NO: 9893 - RNA, 9873 nt, Artificial Sequence
  derived and/or modified CDS sequence (opt1) from DENV-3__GU131862__SS-prME
accagccugugccucgugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggaccugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggucaucuucauccugcugaugcucgugacgcccagcaugaccaugcgcugcgugggggucggcaaccgggacuucguggagggccuguccggggccaccuggguggacgucgugcuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccguccugccggaggagcaggaccagaacuacgugugcaagcacaccuacguggaccgcggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucgugcugaagaaggagguguccgagacccagcacgggaccauccucaucaaggucgaguaccggggcgaggacgcgccgugcaagauccccuucagcaccgaggacgggcagggcaaggcccacaacggccgccugaucacggccaaccccguggugaucaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcgggguccucaacagccugggcaagauggugcaccagaucuucggguccgccuacaccgcccuguucagcggcguguccugggucaugaagaucggcaucgggauccuccugacguggaucggccugaacagcaagaacaccuccaugagcuucuccugcaucgccaucgggaucaucacccucuaccugggcgccguggugcaggcggacaucgggugcgucaucaacuggaagggcaaggagcugaagugcggcagcgggaucuucgugaccaacgaggugcacacguggaccgagcaguacaaguuccaggccgacucccccaagcggcucgccaccgccaucgccggcgcgugggagaacggggucugcggcauccgcagcaccacgcggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagacgugggggaaggccaagaucgugaccgccgagacccagaacagcuccuucaucaucgacggccccaacacccccgagugccccagcgcgucccgggccuggaacgucugggagguggaggacuacggguucggcguguucacgaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcaccuggccgaagucccacacgcucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcaccacgguggucaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucaccaugggcgugcugugccucgcgauccuguucgaggaggucaugcgggggaaguucggcaagaagcacaugaucgccgggguguucuucacguucgugcugcuccuguccggccagaucaccuggcgcgacaugacccacacccugaucaugaucggcagcaacgccuccgaccggauggggaugggcgucacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccauguucacccugaccguggccuggcgcacggccacccugauccucgcgggggucagccugcugccggugugccaguccagcuccaugcgcaagaccgacuggcuccccauggccgucgccgccaugggcgugccgccccucccgcuguucaucuucagccucaaggacacccugaagcggcgcuccuggccccugaacgagggggugauggccgucggccucgugagcauccuggcguccagccugcuccggaacgacgugcccauggccggcccccuggucgccgggggccugcucaucgccugcuacgugaucacggggaccuccgccgaccugaccguggagaaggcggccgacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcguguucccguacagcauccccgccacccugcucguguggcacaccuggcagaagcagacccagcgguccggcguccugugggacgugcccagcccgcccgagacgcagaaggcggagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggcgaucauccgggaggccaucaagcgccggcuccgcacgcugauccuggcccccacccgggucguggccgccgagauggaggaggcgcucaaggggcugcccauccgcuaccagaccaccgccacgaaguccgagcacaccggccgggagaucguggaccugaugugccacgccaccuucaccaugcgccuccugagccccguccgggugccgaacuacaaccugaucaucauggacgaggcccacuucacggaccccgccuccaucgcggcccgcggguacaucagcacccgcgugggcaugggcgaggccgccgcgaucuucaugaccgccacgccgcccgggacggccgacgccuucccgcaguccaacgcccccauccaggacgaggagcgggacauccccgagcgcagcuggaacuccggcaacgaguggaucaccgacuucgucgggaagaccgugugguucgugcccagcaucaaggcgggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagucccggaagacguucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgcuggcuggacgcccggaccuacuccgacccgcuggcccucaaggaguucaaggacuucgccgcgggccgcaagagcaucacgcuggaccuggugaccgagaucgggcgggugcccucccaccucgcccaccgcacccggaacgcccuggacaaccuggucaugcuccacaccagcgagcacggcgggcgcgccuaccggcacgccguggaggagcugcccgagacgauggagacccugcuccugcugggccucaugauccugcugaccgggggcgcgaugcuguuccugaucagcggcaaggggaucggcaagaccuccaucgggcugaucugcgugaucgccagcuccggcaugcucuggauggccgagaucccgcugcaguggaucgccagcgccaucguccuggaguucuucaugauggugcuccugauccccgagcccgagaagcagcgcacgccccaggacaaccagcuggcguacguggucaucgggauccucacccuggccgccaucaucgccgccaacgagaugggccugcucgagaccaccaagcgggaccugggcauguccaaggagccggggguggugagccccaacuccuaccuggacgucgaccuccaccccgcgagcgccuggacgcuguacgccguggccaccaccgugaucacccccaugcugcgccacacgaucgagaacuccaccgcgaacgucagccucgccgccaucgccaaccaggccguggugcugaugggccuggacaagggguggccgaucuccaagauggaccucggcgucccccugcuggcgcucgggugcuacagccaggugaacccccugacccugaccgccgccgugcuccugcugaucacgcacuacgccaucaucggccccggccuccaggccaaggcgacccgggaggcccagaagcgcaccgccgccgggaucaugaagaacccgaccgucgacggcaucaugacgaucgaccuggaccccgugaucuacgacuccaaguucgagaagcagcugggccaggugaugcuccugguccugugcgccgugcagcuccugcugaugcggaccagcugggcgcucugcgaggcccugacccuggccaccggccccaucacgacccucugggagggcucccccgggaaguucuggaacaccaccaucgccgugagcauggcgaacaucuuccgcggcuccuaccuggccggggccggccuggccuucagcaucaugaaguccgucgggacgggcaagcggggcaccgggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagaucacgcaccacgcggugagccggggcuccgccaagcugcagugguucgucgagcgcaacauggugaucccggaggggcgggugaucgaccucggcugcgggcgcggcggguggagcuacuacugcgccggccugaagaaggucaccgaggugcgcggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccggaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacgcacgagauguacuggaucuccaacggcaccgggaacaucguggccagcgucaacauggugucccggcuccugcugaaccgcuucaccaugacccaccggcgcccgacgaucgagaaggacguggaccucggcgccggcacccggcacgucaacgcggagcccgagacccccaacauggacgugaucggggagcgcaucaagcggaucaaggaggagcacaacagcaccuggcacuacgacgacgagaacccguacaagacgugggccuaccacggcuccuacgaggugaaggccaccgggagcgccuccagcaugaucaacggcgucgugaagcugcugaccaagcccugggacgucgugcccauggugacccagauggccaugacggacaccacccccuucgggcagcagcgcgucuucaaggagaagguggacacccggacgccgcgcagcaugcccggcacccggcgcgugaugggcaucaccgcggaguggcucuggaagacccuggggcggaacaagaagccccgccugugcacgcgcgaggaguucaccaagaagguccggaccaacgccgccaugggcgccguguucaccgaggagaaccagugggacuccgcgaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggccaucugguacauguggcugggcgcgcgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacacggccgggugggacacccggaucaccgaggacgaccugcacaacgaggagaagaucacccagcagauggacccggagcaccgccagcucgcgaacgccaucuucaagcugacguaccagaacaaggucgugaaggugcagcggcccacccccaccggcaccgucauggacaucaucagccgcaaggaccagcggggcuccggccaggugggcaccuacgggcugaacacguucaccaacauggaggcccagcucauccgccagauggagggcgagggggugcugagcaaggccgaccuggagaacccccaccucccggagaagaagaucacccaguggcuggagaccaagggcgucgagcggcugaagcgcauggccaucuccggcgacgacugcguggugaagcccaucgacgaccgguucgcgaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggccggcuggucccuccgcgagacggcgugccugggcaaggccuacgcccagauguggagccugauguacuuccaccggcgcgaccuccggcuggccuccaacgcgaucugcagcgccgugcccgugcacugggucccgaccucccgcaccaccuggagcauccacgcccaccaccaguggaugacgaccgaggacaugcugaccguguggaaccggguguggaucgaggacaaccccuggauggaggacaagacccccgucacgaccugggagaacgugcccuaccucgggaagcgcgaggaccaguggugcggcagccugaucgggcugaccucccgggccaccugggcccagaacaucccgacggcgauccagcagguccgcagccucaucggcaacgaggaguuccuggacuacaugcccuccaugaagcgguuccgcaaggaggaggagagcgagggggccaucugguga

SEQ ID NO: 9894 - RNA, 9873 nt, Artificial Sequence
  derived and/or modified CDS sequence (opt1) from DENV-3__GU131865__SS-prME
accagccucugccucgugaugauccugcccgccgcccuggcguuccaccucaccagccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccaggucgagaagguggagacgugggcccugcggcacccgggguucaccauccucgcgcuguuccuggcccacuacaucggcaccucccucacccagaagguggucaucuucauccugcugaugcucgugacgcccagcaugaccaugcgcugcgugggggucggcaaccgggacuucguggagggccuguccggggccaccuggguggacgucgugcuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccguccugccggaggagcaggaccagaacuacgugugcaagcacaccuacguggaccgcggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucgugcugaagaaggagguguccgagacccagcacgggaccauccucaucaaggucgaguaccggggcgaggacgcgccgugcaagauccccuucagcaccgaggacgggcagggcaaggcccacaacggccgccugaucacggccaaccccguggugaccaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcgggguccucaacagccugggcaagauggugcaccagaucuucggguccgccuacacggcccuguucagcggcguguccugggucaugaagaucggcaucgggauccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcggcucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacaugacccacacgcugaucaugaucggcagcaacgccuccgaccggauggggaugggcgucaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccauguucacccugacgguggccuggcgcaccgccacccugauccucgcgggggucagccugcugccggugugccaguccagcuccaugcgcaagaccgacuggcuccccauggccgucgccgccaugggcgugccgccccucccgcuguucaucuucagccucaaggacacgcugaagcggcgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugaccguggagaaggcggccgacaucacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcguguucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccacccccggcacguuccagaccaccaccggggagaucggcgccaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucauccgggaggccaucaagcgccggcuccgcacccugauccuggcccccacccgggucguggccgccgagauggaggaggcgcucaaggggcugcccauccgcuaccagacgaccgugaccaaguccgagcacaccggccgggagaucgucgaccugaugugccacgccacguucaccaugcgccuccugagccccgugcgggugccgaacuacaaccugaucaucauggacgaggcccacuucaccgaccccgccuccaucgccgcgcgcggguacaucagcacccgcgucggcaugggcgaggccgccgccaucuucaugacggcgacgccgcccgggaccgccgacgccuucccgcaguccaacgcccccauccaggacgaggagcgggacauccccgagcgcagcuggaacuccggcaacgaguggaucaccgacuucgccgggaagacggugugguucgugcccagcaucaaggcgggcaacgacaucgccaacugccuccggaagaacgggaagaaggucauccagcugucccgcaagaccuucgacaccgaguaccagaagaccaagcugaacgacugggacuucguggugacgaccgacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggacgaaggagggcgagaagaagaagcuccgcccccgcuggcuggacgcccggaccuacuccgacccgcuggcccucaaggaguucaaggacuucgccgcgggccgcaagagcaucgcccuggaccuggugaccgagaucgggcgggugcccucccaccucgcccaccgcacccggaacgcccuggacaaccuggucaugcuccacacgagcgagcacggcgggcgcgccuaccggcacgcgguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgccagcgcggucgugcuggaguucuucaugauggugcuccugauccccgagcccgagaagcagcgcacgccccaggacaaccagcuggccuacgucgugaucgggauccucacccuggccgccaucaucgccgcgaacgagaugggccugcucgagaccacgaagcgggaccugggcauguccaaggagccggggguggucagccccaccuccuaccuggacguggaccuccaccccgccagcgccuggacccuguacgccguggcgaccacggucaucacccccaugcugcgccacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacgcugaccgccgccguccuccugcugaucacccacuacgccaucaucggccccggccuccaggcgaaggccacccgggaggcccagaagcgcacggccgccgggaucaugaagaacccgaccguggacggcaucaugaccaucgaccuggaccccgugaucuacgacuccaaguucgagaagcagcuggggcaggucaugcuccuggugcugugcgcggugcagcuccugcugaugcggaccagcugggcccucugcgaggcccugacgcuggccaccggccccaucaccacccucugggagggcucccccgggaaguucuggaacacgaccaucgcggucagcauggccaacaucuuccgcggcuccuaccuggccggggccggccuggccuucagcaucaugaaguccguggggaccggcaagcggggcaccgggagccagggcgagacccucggggagaaguggaagcgcaagcugaaccagcugagccggaaggaguucgaccucuacaagaaguccggcaucacggagguggaccgcaccgaggcgaaggaggggcugaagcggggcgagaucacccaccacgccgucagccgcggcuccgccaagcugcagugguucguggagcggaacauggugaucccggaggggcgcgucaucgaccucggcugcgggcgcggcggguggagcuacuacugcgccggccugaagaaggugaccgaggugcggggcuacacgaagggcgggcccgggcacgaggagcccguccccauguccaccuacggcuggaacaucgugaagcugaugaccgggaaggacguguucuaccucccgcccgagaagugcgacacccugcugugcgacaucggcgagagcucccccagccccacggucgaggagucccgcaccauccgggugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacccacgagauguacuggaucagcaacggcacggggaacaucgucgccuccgugaacauggugagccgccuccugcugaaccgguucaccaugacccaccgccggccgaccaucgagaaggacgucgaccucggcgcgggcacgcgccacgugaacgccgagcccgagacccccaacauggacgugaucggggagcggaucaagcgcaucaaggaggagcacaacuccaccuggcacuacgacgacgagaacccguacaagaccugggccuaccacggcagcuacgaggucaaggccacgggguccgccagcuccaugaucaacggcguggucaagcugcugaccaagcccugggacguggugcccauggucacccagauggcgaugaccgacacgacccccuucgggcagcagcggguguucaaggagaagguggacacccgcaccccgcggagcaugcccggcacgcgccgggucauggagaucaccgccgaguggcucuggcgcacccugggccgcaacaagaagccccggcugugcacccgcgaggaguucacgaagaaggugcggaccaacgccgccaugggggcgguguucaccgaggagaaccagugggacagcgccaaggccgccgucgaggacgaggacuucuggaagcucguggaccgcgagcgggagcugcacaagcugggcaagugcggguccugcguguacaacaugaugggcaagcgcgagaagaagcucggggaguucggcaaggccaagggcagccgggcgaucugguacauguggcugggggcccgcuaccuggaguucgaggcccucggcuuccugaacgaggaccacugguucucccgggagaacagcuacuccggggucgagggcgaggggcugcacaagcucggcuacauccugcgcgacaucagcaagauccccggcggggccauguacgccgacgacaccgcgggcugggacacgcggaucaccgaggacgaccugcacaacgaggagaagaucacccagcagauggacccggagcaccgccagcucgccaacgccaucuucaagcugaccuaccagaacaagguggugaagguccagcggcccacccccacggggaccgugauggacaucaucucccgcaaggaccagcggggcagcggccagguggggaccuacggccugaacaccuucacgaacauggagguccagcucauccgccagauggagggggagggcgugcuguccaaggccgaccuggagaacccccaccucccggagaagaagaucacccaguggcuggagaccaaggggguggagcggcugaagcgcauggccaucagcggcgacgacugcgucgugaagcccaucgacgaccgguucgcgaacgcccuccuggcccugaacgacaugggcaaggugcgcaaggacaucccccaguggcagcccuccaagggguggcacgacuggcagcaggucccguucugcagccaccacuuccacgagcucaucaugaaggacggccggaagcugguggugcccugccgcccccaggacgagcugaucgggcgcgcccggaucucccagggcgccggguggagccuccgcgagaccgcgugccugggcaaggccuacgcccagauguggucccugauguacuuccaccggcgcgaccuccggcuggccagcaacgcgaucugcuccgccguccccgugcacugggugccgacgagccgcaccaccugguccauccacgcccaccaccaguggaugaccacggaggacaugcugaccgucuggaaccggguguggaucgaggacaaccccuggauggaggacaagacccccgugaccacgugggagaacguccccuaccucggcaagcgcgaggaccaguggugcgggagccugaucggccugaccagccgggccaccugggcccagaacaucccgaccgcgauccagcagguccgcucccucaucgggaacgaggaguuccuggacuacaugcccagcaugaagcgguuccgcaaggaggaggaguccgagggcgccaucugguga

SEQ ID NO: 9895 - RNA, 9873 nt, Artificial Sequence
  derived and/or modified CDS sequence (opt1) from DENV-3__GU131866__SS-prME
accagccugugccugaugaugauccugcccgccgcccuggcguuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggaccgccgguccguggcccucgcgccccacgugggcauggggcuggacacccgcacccagaccuggaugagcgccgagggcgccuggcgccagguggagaagguggagacgugggcccugcgccaccccggguucaccauccucgcgcuguuccuggcccacuacaucggcaccucccucacccagaagguggugaucuucauccugcugaugcucgugacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugcccgaggagcaggaccagaacuacgucugcaagcacaccuacguggaccggggguggggcaacgggugcggccucuucgggaagggcucccuggugaccugcgccaaguuccagugccuggagcucaucgagggcaaggucgugcaguacgagaaccugaaguacaccgugaucaucacgguccacaccggggaccagcaccaggugggcaacgagacccagggggucaccgccgagaucacgccccaggccagcaccaccgaggcgauccugcccgaguacggcacccucgggcuggagugcagcccccggaccggccuggacuucaacgagaugauccuccugacgaugaagaacaaggccuggauggugcaccggcagugguucuucgaccugccgcuccccuggaccagcggcgccaccaccgagacgcccaccuggaaccgcaaggagcugcuggugaccuucaagaacgcccacgccaagaagcaggaggucguggugcucgggucccaggagggcgcgaugcacaccgcccugacgggggccaccgagauccagaacagcggcgggaccuccaucuucgccggccaccugaagugccggcucaagauggacaagcuggagcugaagggcaugagcuacgccaugugcaccaacacguucguccucaagaaggagguguccgagacccagcacgggaccauccugaucaagguggaguacaagggcgaggacgcgcccugcaagaucccguucagcaccgaggacgggcagggcaaggcccacaacggccgccugaucacggccaaccccgucgugaccaagaaggaggagcccgugaacaucgaggccgagcccccguucggggagagcaacaucgucaucggcaucggggacaacgcgcugaagaucaacugguacaagaagggcuccagcaucgggaagauguucgaggccaccgcccggggcgcccgccgcauggccauccucggcgacaccgcgugggacuucggguccgugggcggggugcugaacagccugggcaagaugguccaccagaucuucggguccgccuacacggcccucuucagcggcguguccugggugaugaagaucggcaucgggguccugcugaccuggaucggccucaacagcaagaacaccuccaugagcuucuccugcaucgccaucgggaucaucacccuguaccugggcgccguggugcaggcggacauggggugcgucaucaacuggaagggcaaggagcucaagugcggcagcgggaucuucgugacgaacgaggugcacgccuggaccgagcaguacaaguuccaggccgacucccccaagcggcuggccaccgccaucgcgggcgccugggagaacggggucugcggcauccgcagcaccacgcggauggagaaccugcucuggaagcagaucgccaacgagcugaacuacauccugugggagaacaacaucaagcucaccgugguggucggggacaucaucggcgugcuggagcagggcaagcgcacccugacgccccagcccauggagcucaaguacuccuggaagacgugggggaaggccaagaucgugaccgcggagacccagaacagcuccuucaucaucgacggcccgaacacccccgagugccccagcgccucccgggccuggaacgucugggagguggaggacuacggguucggcguguucacgaccaacaucuggcugaagcugcgcgaggucuacacccagcucugcgaccaccggcugaugagcgccgccgugaaggacgagcgcgcggugcacgccgacaugggcuacuggaucgagagccagaagaacggguccuggaagcuggagaaggccagccucaucgaggucaagaccugcaccuggcccaagucccacacgcuguggagcaacggcgugcuggaguccgacaugaucauccccaagucccucgccgggcccaucucccagcacaaccaccggcccggcuaccacacccagaccgccgggccguggcaccugggcaagcuggagcucgacuucaacuacugcgagggcaccacgguggucaucaccgagaacugcgggacccgcggccccagccugcggaccacgaccguguccgggaagcugauccacgaguggugcugccgcagcugcacccugccgccccuccgguacaugggcgaggacgggugcugguacggcauggagauccgcccgaucuccgagaaggaggagaacauggucaagagccuggucuccgcgggcagcgggaagguggacaacuucaccaugggcgugcucugccuggccauccuguucgaggaggucaugcgggggaaguucggcaagaagcacaugaucgccgggguguucuucacguucgugcuccugcuguccggccagaucaccuggcgcgacauggcccacacccucaucaugaucggcagcaacgccuccgaccggauggggaugggcgucaccuaccuggcgcugaucgccacguucaagauccagcccuuccucgcccugggguucuuccugcgcaagcucaccagccgggagaaccugcugcucggcgugggccuggccauggcgaccacccugcagcuccccgaggacaucgagcagauggccaacgggaucgcccugggccugauggcccucaagcugaucacgcaguucgagaccuaccagcuguggaccgcccucaucagccugaccugcuccaacacgauguucacccugaccguggcguggcgcaccgccacgcucauccuggccggggucagccugcuccccgugugccaguccagcuccaugcgcaagaccgacuggcugccgauggccgucgccgcgaugggcgugccgccccugccccucuucaucuucagccugaaggacacccugaagcggcgcuccuggccgcucaacgagggggugauggccgucggccuggugagcauccuggccuccagccuccugcggaacgacgugcccauggccggcccccuggucgccgggggccuccugaucgcgugcuacgugaucaccgggacguccgccgaccugaccguggagaaggccgccgacaucaccugggaggaggaggccgagcagaccggcgucagccacaaccucaugaucacgguggacgacgacgggaccaugcgcaucaaggacgacgagaccgagaacauccugaccgugcugcucaagaccgcgcugcugaucgucuccggcguguuccccuacagcaucccggccacgcuccugguguggcacaccuggcagaagcagacccagcgguccggcguccugugggacgugcccuccccgcccgagacccagaaggccgagcucgaggaggggguguaccgcaucaagcagcagggcaucuucgggaagacgcaggucggcgugggggugcagaaggagggcgucuuccacaccauguggcacgugacccggggcgccgugcugaccuacaacgggaagcgccuggagccgaacugggcguccgucaagaaggaccucaucagcuacggcgggggcuggcggcuguccgcccaguggcagaagggggaggagguccaggugaucgccgucgagcccggcaagaaccccaagaacuuccagacgaugcccggcaccuuccagaccaccacgggggagaucggcgccaucgcccuggacuucaagccggggaccagcggcagccccaucaucaaccgcgagggcaaggugguggggcuguacggcaacggggucgugaccaagaacggcggguacguguccggcaucgcgcagaccaacgccgagcccgacggcccgacgcccgagcucgaggaggagauguucaagaagcggaaccugaccaucauggaccugcaccccgggagcggcaagacccgcaaguaccuccccgccaucguccgggaggccaucaagcgccggcugcgcacccugauccucgccccgacgcgggugguggcggccgagauggaggaggcccugaaggggcugcccauccgcuaccagaccaccgccaccaaguccgagcacacgggccgggagaucgucgaccucaugugccacgccaccuucaccaugcgccugcugagccccgugcgggugcccaacuacaaccucaucaucauggacgaggcgcacuucaccgacccggccuccaucgccgcccgcggguacaucagcacgcgcgucggcaugggcgaggcggccgccaucuucaugaccgccacgccgcccgggaccgccgacgcguucccccaguccaacgccccgauccaggacgaggagcgggacauccccgagcgcagcuggaacuccggcaacgaguggaucacggacuucgccgggaagaccgugugguucgugcccagcaucaaggccggcaacgacaucgccaacugccugcggaagaacgggaagaaggucauccagcugucccgcaagaccuucgacaccgaguaccagaagacgaagcucaacgacugggacuucguggugaccaccgacaucagcgagaugggcgcgaacuucaaggccgaccgggucaucgacccccgccggugccugaagccggugauccugaccgacggccccgagcgcgugauccucgccgggcccaugcccgucacggccgccuccgcggcccagcggcgcggccggguggggcgcaacccgcagaaggagaacgaccaguacaucuucaccggccagccccugaacaacgacgaggaccacgcccacuggaccgaggccaagaugcugcucgacaacaucaacacccccgaggggaucauccccgcgcuguucgagccggagcgggagaaguccgccgccaucgacggcgaguaccgccugaagggcgagucccggaagaccuucguggagcucaugcgccgcggggaccugcccgucuggcuggcccacaagguggccagcgagggcaucaaguacacggaccgcaaguggugcuucgacgggcagcggaacaaccagauccucgaggagaacauggacgucgagaucuggaccaaggagggcgagaagaagaagcugcgcccccgcuggcuggacgcgcggaccuacuccgacccccucgcccugaaggaguucaaggacuucgccgccggccgcaagagcaucgcccuggaccucgugaccgagaucgggcgggugccgucccaccuggcgcaccgcacgcggaacgcccuggacaaccucgucaugcugcacaccagcgagcacggcgggcgcgccuaccggcacgccguggaggagcugcccgagaccauggagacccuccugcugcucggccugaugauccugcucaccggcggggccaugcuguuccugaucagcgggaaggggaucggcaagaccuccaucgggcucaucugcgugaucgcgagcuccggcaugcuguggauggccgagaucccccugcaguggaucgccagcgccaucguccucgaguucuucaugauggugcugcugaucccggagcccgagaagcagcgcacgccccaggacaaccagcucgccuacguggucaucgggauccugacccuggcggccaucaucgccgccaacgagaugggccuccuggagacgaccaagcgggaccugggcauguccaaggagcccgggguggugagcccgaccuccuaccucgacgucgaccugcaccccgcgagcgccuggacccuguacgccguggccacgaccgugaucacccccaugcuccgccacaccaucgagaacuccacggccaacgucagccuggcggccaucgccaaccaggccguggugcugaugggccucgacaagggguggcccaucuccaagauggaccugggcgucccgcugcucgcccuggggugcuacagccaggugaacccccugacccucaccgcggccgugcugcugcucaucacccacuacgccaucaucggccccggccugcaggccaaggccacgcgggaggcgcagaagcgcaccgccgccgggaucaugaagaaccccaccgucgacggcaucaugaccaucgaccuggacccggugaucuacgacuccaaguucgagaagcagcucggccaggugaugcugcugguccucugcgccgugcagcugcugcucaugcggacgagcugggcgcugugcgaggcccugacccucgccaccggccccaucaccacgcugugggagggcucccccgggaaguucuggaacaccaccaucgccgugagcauggccaacaucuuccgcggcuccuaccuggcgggggccggccucgccuucagcaucaugaaguccgucgggaccggcaagcggggcacggggagccagggcgagacccugggggagaaguggaagaagaagcugaaccagcucagccgcaaggaguucgaccuguacaagaaguccggcaucaccgagguggaccggaccgaggccaaggaggggcugaagcgcggcgagaucacccaccacgccgugagccggggcuccgcgaagcuccagugguucgucgagcgcaacauggugauccccgaggggcgggugaucgaccugggcugcgggcgcggcggguggagcuacuacugcgccggccugaagaaggucacggaggugcgcggcuacaccaagggcgggccggggcacgaggagcccgugcccauguccaccuacggcuggaacaucgucaagcucaugagcgggaaggacguguucuaccugcccccggagaagugcgacacccugcugugcgacaucggcgaguccagccccucccccacgguggaggagagccggaccauccgcguccucaagaugguggagcccuggcugaagaacaaccaguucugcaucaaggugcugaacccguacaugcccaccgucaucgagcaccucgagcggcugcagcgcaagcacggcgggaugcuggugcggaacccccucucccgcaacagcacccacgagauguacuggaucuccaacggcacggggaacaucguggccagcgucaacauggugucccggcugcugcucaaccgcuucaccaugacccaccggcgccccaccaucgagaaggacguggaccugggcgccggcacgcggcacgucaacgccgagccggagacccccaacauggacgugaucggggagcgcaucaagcggaucaaggaggagcacaacagcaccuggcacuacgacgacgagaaccccuacaagaccugggcguaccacggcuccuacgaggugaaggccacggggagcgccuccagcaugaucaacggcgucgugaagcugcucaccaagccgugggacgucgugcccauggugacccagauggccaugaccgacacgacccccuucgggcagcagcgcgucuucaaggagaagguggacacccggacgccccgcagcaugccgggcacccggcgcgugaugggcaucaccgcggaguggcuguggcggacccuggggcgcaacaagaagccccgccucugcacccgggaggaguucacgaagaagguccgcaccaacgccgccaugggcgccguguucaccgaggagaaccagugggacuccgccaaggcggccguggaggacgaggacuucuggaagcuggucgaccgggagcgcgagcugcacaagcucgggaagugcggcagcugcguguacaacaugauggggaagcgggagaagaagcugggcgaguucggcaaggccaaggggucccgcgccaucugguacauguggcugggcgcccgguaccucgaguucgaggcgcugggguuccugaacgaggaccacugguucagccgcgagaacuccuacagcggcguggagggggagggccuccacaagcugggcuacauccugcgggacaucuccaagauccccgggggcgccauguacgccgacgacaccgccgggugggacacgcgcaucaccgaggacgaccuccacaacgaggagaagaucacccagcagauggaccccgagcaccggaagcuggccaacgcgaucuucaagcugaccuaccagaacaaggucgugaaggugcagcgcccgacgcccaccggcaccgucauggacaucaucagccggaaggaccagcgcggcuccggccaggugggcaccuacgggcucaacaccuucacgaacauggaggcccagcugauccggcagauggagggcgagggggugcugagcaaggccgaccucgagaacccccaccuccccgagaagaagaucacccaguggcuggagaccaagggcgucgagcgccucaagcggauggccaucuccggcgacgacugcguggugaagccgaucgacgaccgcuucgccaacgcgcugcuggcccucaacgacauggggaagguccggaaggacaucccccaguggcagcccagcaagggcuggcacgacuggcagcagguccccuucugcucccaccacuuccacgagcugaucaugaaggacgggcgcaagcugguggucccgugccggccccaggacgagcucaucggccgcgcccgcaucagccagggggccggcuggucccugcgggagaccgcgugccugggcaaggccuacgcccagauguggagccucauguacuuccaccgccgggaccugcgccuggccuccaacgccaucugcagcgcggugcccgugcacuggguccccacgucccggaccaccuggagcauccacgcccaccaccaguggaugaccacggaggacaugcucaccguguggaaccgcguguggaucgaggacaacccguggauggaggacaagacccccgucaccacgugggagaacgugcccuaccuggggaagcgggaggaccaguggugcggcagccugaucgggcucaccucccgcgccaccugggcccagaacauccccaccgccauccagcagguccggagccugaucggcaacgaggaguuccuggacuacaugccguccaugaagcgcuuccggaaggaggaggagagcgagggggcgaucugguga

SEQ ID NO: 9896 - RNA, 9873 nt, Artificial Sequence
  derived and/or modified CDS sequence (opt1) from DENV-3__GU131868__SS-prME
acgccccugugccucaugaugauccugccggccgcccuggcguuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcggcgggacaagcgcagcguggcccucgcgccgcacgugggcauggggcuggacacccggacccagaccuggaugagcgccgagggcgccuggcgccagguggagaagguggagacgugggcccugcggcaccccggguucaccauccucgcgcuguuccuggcccacuacaucggcaccagccucacccagaagguggugaucuucauccugcugaugcucgucacgcccuccaugaccaugcgcugcgugggggugggcaaccgggacuucgucgagggccugagcggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacucccggugcccgacgcagggcgaggccgugcugcccgaggagcaggaccagaacuacgucugcaagcacaccuacguggaccgcggguggggcaacgggugcggccucuucgggaagggcagccuggugaccugcgccaaguuccagugccuggagcucaucgagggcaaggucgugcaguacgagaaccugaaguacaccgugaucaucacgguccacaccggggaccagcaccaggugggcaacgagacccagggggucaccgccgagaucacgccccaggccuccaccaccgaggcgauccugcccgaguacggcacccucgggcuggagugcagcccgcggaccggccuggacuucaacgagaugauccuccugacgaugaagaacaaggccuggauggugcaccgccagugguucuucgaccugccccuccccuggaccuccggcgccaccaccgagacgcccaccuggaaccggaaggagcugcuggugaccuucaacaacgcccacgccaagaagcaggaggucguggugcucgggagccaggagggcgcgaugcacaccgcccugacgggggccaccgagauccagaacuccggcgggaccagcaucuucgccggccaccugaagugccgccucaagauggacaagcuggagcugaagggcauguccuacgccaugugcaccaacacguucguccucaagaaggaggugagcgagacccagcacgggaccauccugaucaagguggaguacaagggcgaggacgcgccgugcaagauccccuucuccaccgaggacgggcagggcaaggcccacaacggccggcugaucacggccaaccccgucgugaccaagaaggaggagcccgugaacaucgaggccgagccgcccuucggggagagcaacaucgucaucggcaucggggacaacgcgcugaagaucaacugguacaagaagggcagcuccaucgggaagauguucgaggccaccgcccgcggcgcccggcgcauggccauccucggcgacaccgcgugggacuucgggagcgugggcggggugcugaacucccugggcaagaugguccaccagaucuucgggagcgccuacacggcccucuucuccggcgugagcugggugaugaagaucggcaucgggguccugcugaccuggaucggccucaacuccaagaacaccagcauguccuucagcugcaucgccaucgggaucaucacccuguaccugggcgccguggugcaggcggacauggggugcgucaucaacuggaagggcaaggagcucaagugcggcuccgggaucuucgugacgaacgaggugcacaccuggaccgagcaguacaaguuccaggccgacagccccaagcgccuggccaccgccaucgccggcgcgugggagaacggggucugcggcauccgguccacgacccgcauggagaaccugcucuggaagcagaucgccaacgagcugaacuacauccugugggagaacaacaucaagcucaccgugguggucggggacaucaucggcgugcuggagcagggcaagcggacccugacgccccagccgauggagcucaaguacagcuggaagaccugggggaaggccaagaucgugaccgccgagacccagaacuccagcuucaucaucgacggccccaacacgcccgagugccccuccgcgagccgcgccuggaacgucugggagguggaggacuacggguucggcguguucaccaccaacaucuggcugaagcugcgggaggucuacacccagcucugcgaccaccgccugauguccgccgccgugaaggacgagcgggccgugcacgcggacaugggcuacuggaucgagagccagaagaacgggagcuggaagcuggagaaggccucccucaucgaggucaagaccugcacguggcccaagagccacacccugugguccaacggcgugcuggagagcgacaugaucauccccaagucccucgccgggcccaucagccagcacaaccaccgcccgggcuaccacacccagaccgccgggcccuggcaccugggcaagcuggagcucgacuucaacuacugcgagggcacgaccguggucaucaccgagaacugcgggacccggggccccucccugcgcacgaccaccgugagcgggaagcugauccacgaguggugcugccgguccugcacccugccgccccugcgcuacaugggcgaggacgggugcugguacggcauggagauccggcccaucagcgagaaggaggagaacauggugaagucccuggucagcgccggcuccgggaagguggacaacuucacgaugggcgugcucugccuggcgauccuguucgaggaggucaugcgcgggaaguucggcaagaagcacaugaucgccgggguguucuucaccuucgugcuccugcugagcggccagaucaccuggcgggacauggcccacacccucaucaugaucggcuccaacgccagcgaccgcauggggaugggcgucacguaccuggcccugaucgcgaccuucaagauccagcccuuccucgcccugggguucuuccugcggaagcucaccucccgcgagaaccugcugcucggcgugggccuggccauggccaccacgcugcagcuccccgaggacaucgagcagauggcgaacgggaucgcccugggccugauggcccucaagcugaucacccaguucgagaccuaccagcuguggaccgcccucaucagccugacgugcagcaacaccauguucacccugaccguggccuggcggacggcgacccucauccuggccggggucucccugcucccggugugccagagcuccagcaugcgcaagaccgacuggcugcccauggccgucgccgccaugggcgugccgccccucccccucuucaucuucucccugaaggacacccugaagcgccggagcuggccccucaacgagggggugauggcggucggccugguguccauccuggccagcucccuccugcgcaacgacgugcccauggccggcccccuggucgccgggggccuccugaucgccugcuacgugaucacggggaccagcgcggaccugaccguggagaaggccgccgacaucaccugggaggaggaggccgagcagacgggcgucucccacaaccucaugaucaccguggacgacgacgggaccaugcggaucaaggacgacgagaccgagaacauccugaccgugcugcucaagacggcccugcugaucgucagcggcguguucccguacuccauccccgcgacccuccugguguggcacaccuggcagaagcagacccagcgcagcggcguccugugggacgugcccagcccgcccgagacgcagaaggccgagcucgaggaggggguguaccggaucaagcagcagggcaucuucgggaagacccaggucggcgugggggugcagaaggagggcgucuuccacaccauguggcacgugacccgcggcgccgugcugacguacaacgggaagcggcuggagcccaacugggccagcgucaagaaggaccucaucuccuacggcgggggcuggcgccugagcgcgcaguggcagaagggggaggagguccaggugaucgccgucgagcccggcaagaaccccaagaacuuccagaccaugccgggcaccuuccagaccacgaccggggagaucggcgccaucgcccuggacuucaagcccgggaccuccggcagccccaucaucaaccgggagggcaaggugguggggcuguacggcaacggggucgugaccaagaacggcggguacgugagcggcaucgcccagacgaaggcggagccggacggccccacccccgagcucgaggaggagauguucaagaagcgcaaccugaccaucauggaccugcaccccggguccggcaagacccggaaguaccucccggccaucguccgcgaggccaucaagcggcgccugcggacgcugauccucgcccccacccgcgugguggccgcggagauggaggaggcccugaaggggcugcccauccgguaccagaccaccgccaccaaguccgagcacaccggccgcgagaucgucgaccucaugugccacgccaccuucaccaugcggcugcugucccccgugcgcgugccgaacuacaaccucaucaucauggacgaggcccacuucacggaccccgcgagcaucgccgcccggggguacaucuccacccgcgucggcaugggcgaggccagcgcgaucuucaugaccgccacgccgcccgggacggccgacgccuucccgcaguccaacgcccccauccaggacgaggagcgcgacauccccgagcggagcuggaacuccggcaacgaguggaucaccgacuucgcggggaagaccgugugguucgugcccagcaucaaggccggcaacgacaucgccaacugccugcgcaagaacgggaagaaggucauccagcugucccggaagaccuucgacacggaguaccagaagaccaagcucaacgacugggacuucguggugaccaccgacaucagcgagaugggcgccaacuucaaggccgaccgcgucaucgacccgcggcgcugccugaagcccgugauccugacggacggccccgagcgggugauccucgcggggcccaugccggucaccgccgccuccgccgcccagcgccggggccgcguggggcggaacccccagaaggagaacgaccaguacaucuucaccggccagccccugaacaacgacgaggaccacgcgcacuggaccgaggccaagaugcugcucgacaacaucaacacccccgaggggaucaucccggcccuguucgagcccgagcgcgagaaguccgccgcgaucgacggcgaguaccggcugaagggcgagucccgcaagacguucguggagcucaugcggcgcggggaccugcccgucuggcuggcccacaagguggccagcgagggcaucaaguacaccgaccggaaguggugcuucgacgggcagcgcaacaaccagauccucgaggagaacauggacgucgagaucuggaccaaggagggcgagaagaagaagcugcggccccgcuggcuggacgcccgcaccuacuccgacccgcucgcccugaaggaguucaaggacuucgcggccggccgcaagagcaucgcccuggaccucgugacggagaucgggcgcgugcccucccaccuggcccaccggacccgcaacgcccuggacaaccucgucaugcugcacaccagcgagcacggcgggcgggcguaccgccacgccguggaggagcugcccgagaccauggagacgcuccugcugcucggccugaugauccugcucaccgggggcgccaugcuguuccugaucagcggcaaggggaucggcaagaccuccaucgggcucaucugcgugaucgccagcuccggcaugcuguggauggccgagaucccgcugcaguggaucgcgagcgccaucguccucgaguucuucaugauggugcugcugauccccgagcccgagaagcagcggacgccccaggacaaccagcucgccuacguggucaucgggauccugacgcuggccgccaucaucgcggccaacgagaugggccuccuggagaccaccaagcgcgaccugggcauguccaaggagccgagcguggugucccccaccagcuaccucgacgucgaccugcaccccgccuccgccuggacgcuguacgcgguggccaccaccgugaucacccccaugcuccggcacacgaucgagaacagcaccgccaacgucucccuggccgccaucgcgaaccaggccguggugcugauggggcucgacaagggcuggccgaucagcaagauggaccugggggucccccugcucgcccugggcugcuacucccaggugaacccccugacccucaccgccgccguguuccugcugaucacgcacuacgcgaucaucgggcccggccuccaggccaaggccacccgcgaggcccagaagcggaccgccgcgggcaucaugaagaacccgaccgucgacgggaucaugacgaucgaccuggaccccgugaucuacgacagcaaguucgagaagcagcugggccaggugaugcuccugguccugugcgccgugcagcuccugcugaugcgcaccuccugggcccucugcgaggcccugacccuggcgaccgggcccaucacgacccucugggagggcagccccggcaaguucuggaacaccaccaucgccguguccauggccaacaucuuccgggggagcuaccuggccggcgccgggcuggcguucuccaucaugaaguccgucggcacggggaagcgcggcaccggcagccagggggagacccucggcgagaaguggaagaagaagcugaaccagcugucccggaaggaguucgaccucuacaagaaguccgggaucaccgagguggaccgcaccgaggccaaggagggccugaagcgcggggagaucacgcaccacgccgugucccgcggcagcgccaagcugcagugguucgucgagcggaacauggugaucccggagggccgcgugaucgaccucgggugcggccgcgggggcugguccuacuacugcgccgggcugaagaaggucaccgaggugcgcggcuacaccaagggcgggcccggccacgaggagcccgugcccaugagcaccuacggguggaacaucgucaagcugauguccggcaaggacguguucuaccucccgcccgagaagugcgacacgcugcugugcgacaucggggagagcucccccagccccaccguggaggagucccgcaccauccggguccugaagaugguggagccguggcucaagaacaaccaguucugcaucaaggugcugaaccccuacaugcccaccgucaucgagcaccuggagcgccuccagcggaagcacggcggcaugcuggugcgcaacccccugagccggaacuccacgcacgagauguacuggaucagcaacgggaccggcaacaucguggcguccgucaacauggugagccgccuccugcugaaccgguucaccaugacccaccgccggccgacgaucgagaaggacguggaccucggggccggcacccgccacgucaacgccgagcccgagacccccaacauggacgugaucggcgagcggaucaagcgcaucaaggaggagcacaacuccaccuggcacuacgacgacgagaacccguacaagacgugggccuaccacgggagcuacgaggugaaggccaccggcuccgcgagcagcaugaucaacggggucgugaagcugcugaccaagcccugggacgucgugcccauggugacccagauggccaugacggacaccacccccuucggccagcagcgggucuucaaggagaagguggacacccgcacgccgcgguccaugcccgggacccgccgggugaugggcaucaccgccgaguggcucuggcgcacccugggccggaacaagaagccccgccugugcacgcgcgaggaguucaccaagaagguccggaccaacgccgcgaugggggccguguucaccgaggagaaccagugggacagcgccaaggccgccguggaggacgaggacuucuggaagcucgucgaccgcgagcgggagcugcacaagcugggcaagugcggguccugcguguacaacaugaugggcaagcgcgagaagaagcucggggaguucggcaaggcgaagggcagccgggccaucugguacauguggcugggggcccgcuaccuggaguucgaggcccucggcuuccugaacgaggaccacugguucucccgggagaacagcuacuccgggguggagggcgaggggcugcacaagcucggcuacauccugcgcgacaucagcaagauccccggcggggccauguacgcggacgacacggccggcugggacacccggaucaccgaggacgaccugcacaacgaggagaagaucacccagcagauggacccggagcaccgccagcucgccaacgccaucuucaagcugacguaccagaacaaggucgugaaggugcagcggcccacccccaccgggaccgucauggacaucaucucccgcaaggaccagcggggcagcggccagguggggaccuacggccugaacacguucaccaacauggaggcccagcucauccgccagauggagggggagggcgugcuguccaaggcggaccuggagaacccccaccucccggagaagaagaucacccaguggcuggagaccaagggggucgagcggcugaagcgcauggccaucagcggcgacgacugcguggugaagcccaucgacgaccgguucgccaacgcccuccuggcccugaacgacaugggcaagguccgcaaggacaucccccaguggcagcccuccaagggguggcacgacuggcagcaggucccguucugcagccaccacuuccacgagcucaucaugaaggacggccggaagcuggugguccccugccgcccccaggacgagcugaucgggcgggcgcgcaucucccagggcgccggguggagccuccgcgagacggccugccugggcaaggccuacgcgcagauguggucccugauguacuuccaccggcgcgaccuccggcuggccagcaacgccaucugcuccgccgugcccgugcacugggucccgaccagccgcaccaccuggagcauccacgcccaccaccaguggaugacgaccgaggacaugcugaccguguggaaccggguguggaucgaggacaaccccuggauggaggacaagacccccgucacgaccugggagaacgugcccuaccucggcaagcgcgaggaccaguggugcgggucccugaucggccugaccagccgggcgaccugggcccagaacaucccgacggccauccagcagguccgcucccucaucgggaacgaggaguuccuggacuacaugcccagcaugaagcgguuccgcaaggaggaggaguccgagggcgccaucugguga

SEQ ID NO: 9897 - RNA, 9873 nt, Artificial Sequence
  derived and/or modified CDS sequence (opt1) from DENV-3__GU131869__SS-prME
accagccugugccucgugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccaggucgagaagguggagacgugggcccugcggcacccgggguucaccauccucgcgcuguuccuggcccacuacaucggcaccucccucacccagaagguggucaucuucauccugcugaugcucgugacgcccagcaugaccaugcgcugcgugggggucggcaaccgggacuucguggagggccuguccggggccaccuggguggacgucgugcuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccguccugccggaggagcaggaccagaacuacgugugcaagcacaccuacguggaccgcggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucgugcugaagaaggagguguccgagacccagcacgggaccauccucaucaaggucgaguaccggggcgaggacgcgccgugcaagauccccuucagcaccgaggacgggcagggcaaggcccacaacggccgccugaucacggccaaccccguggugaccaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccgcauggccauccugggcgacaucgcgugggacuucggguccgugggcgggguccucaacagccugggcaagauggugcaccagaucuucggguccgccuacaccgcccuguucagcggcguguccugggucaugaagaucggcaucgggauccuccugacguggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugaccaacgaggugcacacguggaccgagcaguacaaguuccaggccgacucccccaagcggcucgccaccgccaucgccggcgcgugggagaacggggucugcggcauccgcagcaccacgcggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagacgugggggaaggccaagaucgugaccgccgagacccagaacagcuccuucaucaucgacggccccaacacccccgagugccccagcgcgucccgggccuggaacgucugggagguggaggacuacggguucggcguguucacgaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcaccuggccgaagucccacacgcucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcaccacgguggucaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucaccaugggcgugcugugccucgcgauccuguucgaggaggucaugcgggggaaguucggcaagaagcacaugaucgccgggguguucuucacguucgugcugcuccuguccggccagaucaccuggcgcgacaugacccacacccugaucaugaucggcagcaacgccuccgaccggauggggaugggcgucacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccauguucacccugaccguggccuggcgcacggccacccugauccucgcgggggucagccugcugccggugugccaguccagcuccaugcgcaagaccgacuggcuccccauggccgucgccgccaugggcgugccgccccucccgcuguucaucuucagccucaaggacacccugaagcggcgcuccuggccccugaacgagggggugauggccgucggccucgugagcauccuggcguccagccugcuccggaacgacgugcccauggccggcccccuggucgccgggggccugcucaucgccugcuacgugaucacggggaccuccgccgaccugaccguggagaaggcggccgacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcguguucccguacagcauccccgccacccugcucguguggcacaccuggcagaagcagacccagcgguccggcguccugugggacgugcccagcccgcccgagacgcagaaggcggagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccacccccggcaccuuccagacgaccaccggggagaucggcgccaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggcgaucauccgggaggccaucaagcgccggcuccgcacccugauccuggcccccacccgggucguggccgccgagauggaggaggcgcucaaggggcugcccauccgcuaccagaccacggccacccgguccgagcacaccggccgcgagaucguggaccugaugugccacgccaccuucacgaugcggcuccugagccccguccgcgugccgaacuacaaccugaucaucauggacgaggcccacuucaccgaccccgccuccaucgcggcccgcggguacaucagcacccgggugggcaugggcgaggccgccgcgaucuucaugaccgccacgccgcccgggaccgccgacgccuucccgcaguccaacgcccccauccaggacgaggagcgcgacauccccgagcggagcuggaacuccggcaacgaguggaucaccgacuucgcggggaagaccgucugguucgugcccagcaucaaggccggcaacgacaucgccaacugccuccgcaagaacgggaagaaggugauccagcugucccggaagacguucgacaccgaguaccagaagaccaagcugaacgacugggacuucgucgugaccacggacaucagcgagaugggcgccaacuucaaggccgaccgcgugaucgacccgcggcgcugccucaagcccgucauccugaccgacggccccgagcgggugauccuggcggggcccaugccggugaccgccgccuccgccgcccagcgccggggccgcgucgggcggaacccccagaaggagaacgaccaguacaucuucaccggccagccccucaacaacgacgaggaccacgcgcacuggaccgaggccaagaugcugcuggacaacaucaacacgcccgaggggaucaucccggcccucuucgagcccgagcgcgagaaguccgccgcgaucgacggcgaguaccggcugaagggcgagucccgcaagaccuucguggagcugaugcggcgcggggaccuccccguguggcuggcccacaaggucgccagcgagggcaucaaguacaccgaccggaaguggugcuucgacgggcagcgcaacaaccagauccuggaggagaacauggacguggagaucuggaccaaggagggcgagaagaagaagcuccgcccccgguggcuggacgcccgcacguacuccgacccgcuggcccucaaggaguucaaggacuucgcggccggccgcaagagcaucgcccuggaccuggucaccgagaucgggcgcgugcccucccaccucgcccaccggacccgcaacgcccuggacaaccuggugaugcuccacaccagcgagcacggcgggcgggcguaccgccacgccgucgaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucgugcuggaguucuucaugaugguccuccugauccccgagcccgagaagcagcggacgccccaggacaaccagcuggccuacguggugaucgggauccucacccuggccgccaucaucgcggccaacgagaugggccugcucgagaccaccaagcgcgaccugggcauguccaaggagccgggggucgugagccccacguccuaccuggacguggaccuccaccccgccagcgccuggacccuguacgcggucgccaccaccgugaucacgcccaugcugcggcacaccaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacccugacggccgccgugcuccugcugaucacccacuacgcgaucaucggccccggccuccaggccaaggccacccgcgaggcccagaagcggaccgccgcggggaucaugaagaacccgacgguggacggcaucaugaccaucgaccuggaccccgucaucuacgacuccaaguucgagaagcagcugggccaggugaugcuccuggugcugugcgccguccagcuccugcugaugcgcaccagcugggcccucugcgaggcccugacccuggcgacgggccccaucaccacccucugggagggcucccccgggaaguucuggaacaccacgaucgccgugagcauggccaacaucuuccggggcuccuaccuggccggggccggccuggcguucagcaucaugaaguccguggggaccggcaagcgcggcaccgggagccagggcgagacccucggggagaaguggaagaagaagcugaaccagcugagccggaaggaguucgaccucuacaagaaguccggcaucaccgaggucgaccgcacggaggccaaggaggggcugaagcggggcgagaucacccaccacgccgugagccgcggcuccgccaagcugcagugguucguggagcggaacauggucaucccggaggggcgcgugaucgaccucggcugcgggcgcggcggguggagcuacuacugcgccggccugaagaaggugaccgagguccggggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccgcaccauccgggugcugaagauggucgagccguggcucaagaacaaccaguucugcaucaaggugcugaaccccuacaugcccacggugaucgagcaccuggagcgccuccagcggaagcacggcgggaugcugguccgcaacccccugucccggaacagcacccacgagauguacuggaucuccaacggcaccgggaacaucguggcgagcgugaacauggucucccgccuccugcugaaccgguucaccaugacgcaccgccggccgaccaucgagaaggacguggaccucggcgccggcacccgccacgugaacgccgagcccgagacccccaacauggacgucaucggggagcggaucaagcgcaucaaggaggagcacaacagcacguggcacuacgacgacgagaacccguacaagaccugggccuaccacggcuccuacgaggugaaggccaccgggagcgcguccagcaugaucaacggcguggucaagcugcugaccaagcccugggacgugguccccauggugacgcagauggccaugaccgacaccacccccuucgggcagcagcggguguucaaggagaaggucgacacgcgcaccccgcggagcaugcccggcacccgccgggugauggagaucaccgccgaguggcucuggcgcacgcugggccgcaacaagaagccccggcugugcacccgcgaggaguucaccaagaaggugcggaccaacgccgcgaugggggccgucuucacggaggagaaccagugggacuccgccaaggccgccguggaggacgaggacuucuggaagcucguggaccgcgagcgggagcugcacaagcugggcaagugcgggagcugcgucuacaacaugaugggcaagcgcgagaagaagcucggggaguucggcaaggcgaagggcucccgggccaucugguacauguggcugggggcccgcuaccuggaguucgaggcccucggcuuccugaacgaggaccacugguucagccgggagaacuccuacagcgggguggagggcgaggggcugcacaagcucggcuacauccugcgcgacaucuccaagauccccggcggggccauguacgcggacgacaccgccggcugggacacccggaucaccgaggacgaccugcacaacgaggagaagaucacgcagcagauggacccggagcaccgccagcucgccaacgccaucuucaagcugaccuaccagaacaagguggucaaggugcagcggcccacccccaccgggaccgugauggacaucaucagccgcaaggaccagcggggcuccggccaggucgggacguacggccugaacaccuucaccaacauggaggcccagcucauccgccagauggagggggagggcgugcugagcaaggcggaccuggagaacccccaccucccggagaagaagaucacccaguggcuggagacgaaggggguggagcggcugaagcgcauggccaucuccggcgacgacugcgucgugaagcccaucgacgaccgguucgccaacgcccuccuggcccugaacgacaugggcaaggugcgcaaggacaucccccaguggcagcccagcaagggguggcacgacuggcagcaggucccguucugcucccaccacuuccacgagcucaucaugaaggacggccggaagcugguggugcccugccgcccccaggacgagcugaucgggcgcgcgcggaucagccagggcgccggguggucccuccgcgagaccgccugccugggcaaggccuacgcgcagauguggagccugauguacuuccaccggcgcgaccuccggcuggccuccaacgccaucugcagcgccguccccgugcacugggugccgaccucccgcaccacguggagcauccacgcccaccaccaguggaugaccaccgaggacaugcugaccgucuggaaccggguguggaucgaggacaaccccuggauggaggacaagacgcccgugaccaccugggagaacguccccuaccucggcaagcgcgaggaccaguggugcgggagccugaucggccugaccucccgggcgacgugggcccagaacaucccgaccgccauccagcagguccgcagccucaucgggaacgaggaguuccuggacuacaugcccuccaugaagcgguuccgcaaggaggaggagagcgagggcgccaucugguga

SEQ ID NO: 9898 - RNA, 9873 nt, Artificial Sequence
  derived and/or modified CDS sequence (opt1) from DENV-3__GU131870__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucguccugaagaaggagguguccgagacccagcacgggaccauccucaucaagguggaguaccggggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcggggugcucaacagccugggcaagaugguccaccagaucuucggguccgccuacacggcccuguucagcggcguguccugggugaugaagaucggcaucgggauccuccugaccuggaucggccugaacagcaagaacaccuccaugagcuucuccugcaucgccaucgggaucaucacccucuaccugggcgccgucgugcaggcggacauggggugcgugaucaacuggaagggcaaggagcugaagugcggcagcgggaucuucgucacgaacgaggugcacaccuggaccgagcaguacaaguuccaggccgacucccccaagcggcucgccaccgccaucgccggcgcgugggagaacggggugugcggcauccgcagcacgacccggauggagaaccugcuguggaagcagaucgccaacgagcucaaccacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgugugggaggucgaggacuacggguucggcguguucaccaccaacaucuggcucaagcugcgcgagguguacacccagcugugcgaccaccggcucaugagcgccgccgucaaggacgagcgcgccgugcacgcggacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgcgauccuguucgaggaggugaugcgggggaaguucggcaagaagcacaugaucgccggggucuucuucaccuucgugcugcuccuguccggccagaucaccuggcgcgacaugacccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgucggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccauguucacccugacgguggccuggcgcaccgccacccugauccucgcgggggugagccugcugccggucugccaguccagcuccaugcgcaagaccgacuggcuccccauggccguggccgccaugggcgugccgccccucccgcuguucaucuucagccucaaggacacgcugaagcggcgcuccuggccccugaacgagggggugauggccgugggccucgucagcauccuggcguccagccugcuccggaacgacgugcccauggccggcccccugguggccgggggccugcucaucgccugcuacgucaucaccgggaccuccgccgaccugaucguggagaaggcggccgacaucaccugggaggaggaggccgagcagacgggcgugagccacaaccugaugaucaccgucgacgacgacgggaccaugcgcaucaaggacgacgagaccgagaacauccucaccgugcugcugaagacggcccuccugaucguguccggcgucuucccguacagcauccccgccacccugcucguguggcacaccuggcagaagcagacccagcgguccggcgugcugugggacguccccagcccgcccgagacgcagaaggcggagcuggaggaggggguguaccgcaucaagcagcagggcaucuucgggaagacccaggugggcgucggggugcagaaggagggcguguuccacaccauguggcacgucacccggggcgccgugcucacguacaacgggaagcgccuggagcccaacugggccuccgugaagaaggaccugaucagcuacggcgggggcuggcggcucuccgcccaguggcagaagggggaggagguccaggugaucgcgguggagcccggcaagaaccccaagaacuuccagaccaugcccggcaccuuccagaccacgaccggggagaucggcgccaucgcccuggacuucaagcccgggaccagcggcagccccaucaucaaccgcgagggcaaggucguggggcuguacggcaacgggguggucaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggcgaucauccgggaggccaucaagcgccggcuccgcacgcugauccuggcccccacccggguggucgccgccgagauggaggaggcgcucaaggggcugcccauccgcuaccagaccaccgccacgaaguccgagcacaccggccgggagaucguggaccugaugugccacgccaccuucaccaugcgccuccugagccccgugcgggucccgaacuacaaccugaucaucauggacgaggcccacuucacggaccccgccuccaucgcggcccgcggguacaucagcacccgcgugggcaugggcgaggccgccgcgaucuucaugaccgccacgccgcccgggacggccgacgccuucccgcaguccaacgcccccauccaggacgaggagcgggacauccccgagcgcagcuggaacuccggcaacgaguggaucaccgacuucgcggggaagaccgugugguucguccccagcaucaaggccggcaacgacaucgccaacugccuccggaagaacgggaagaaggugauccagcugucccgcaagaccuucgacacggaguaccagaagaccaagcugaacgacugggacuucguggucaccaccgacaucagcgagaugggcgccaacuucaaggccgaccgggugaucgacccgcgccggugccucaagcccgugauccugacggacggccccgagcgcgucauccuggcggggcccaugccggugaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagacguucgucgagcugaugcgccgcggggaccuccccguguggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgcuggcuggacgcccggaccuacuccgacccgcuggcccucaaggaguucaaggacuucgcggccggccgcaagagcaucgcccuggaccuggugacggagaucgggcggguccccucccaccucgcccaccgcacccggaacgcccuggacaaccuggugaugcuccacaccagcgagcacggcgggcgcgcguaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgcgagcgccaucgugcuggaguucuucaugauggugcuccugauccccgagcccgagaagcagcgcacgccccaggacaaccagcuggccuacgucgugaucgggauccucacgcuggccgccaucaucgcggccaacgagaugggccugcucgagaccaccaagcgggaccugggcauguccaaggagccggggguggucagccccaccuccuaccuggacguggaccuccaccccgccagcgccuggacgcuguacgcgguggccaccaccgucaucacccccaugcugcgccacacgaucgagaacuccaccgccaacgugagccucgccgccaucgcgaaccaggccgugguccugaugggccuggacaagggguggccgaucuccaagauggaccucggcgugccccugcuggcccucgggugcuacagccaggugaacccccugacccugaccgccgccguccuccugcugaucacgcacuacgcgaucaucggccccggccuccaggccaaggccacccgggaggcccagaagcgcaccgccgcggggaucaugaagaacccgaccguggacggcaucaugacgaucgaccuggaccccgugaucuacgacuccaaguucgagaagcagcuggggcaggucaugcuccuggugcugugcgccgugcagcuccugcugaugcggaccagcugggcccucugcgaggcccugacccuggcgaccggccccaucacgacccucugggagggcucccccgggaaguucuggaacaccaccaucgccgucagcauggccaacaucuuccgcggcuccuaccuggccggggccggccuggcguucagcaucaugaaguccguggggacgggcaagcggggcaccgggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagaucacgcaccacgccgucagccggggcuccgccaagcugcagugguucguggagcgcaacauggugaucccggaggggcgggucaucgaccucggcugcgggcgcggcggguggagcuacuacugcgccggccugaagaaggugaccgaggugcgcggcuacaccaagggcgggcccgggcacgaggagcccguccccauguccaccuacggcuggaacaucgugaagcugaugagcgggaaggacguguucuaccucccgcccgagaagugcgacacgcugcugugcgacaucggcgaguccagccccucccccaccgucgaggagagccggaccauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugucccgcaacagcacgcacgagauguacuggaucuccaacggcaccgggaacaucgucgcgagcgugaacauggugucccggcuccugcugaaccgcuucaccaugacccaccggcgcccgacgaucgagaaggacgucgaccucggcgccggcacccggcacgugaacgccgagcccgagacccccaacauggacgugaucggggagcgcaucaagcggaucaaggaggagcacaacagcaccuggcacuacgacgacgagaacccguacaagacgugggccuaccacggcuccuacgaggucaaggccaccgggagcgcguccagcaugaucaacggcguggugaagcugcugaccaagcccugggacgucgugcccauggucacccagauggccaugacggacaccacccccuucgggcagcagcgcguguucaaggagaagguggacacccggacgccgcgcagcaugcccggcacccggcgcgucaugggcaucaccgccgaguggcucuggcggacccuggggcgcaacaagaagccccgccugugcacgcgggaggaguucaccaagaaggugcgcaccaacgccgcgaugggcgccguguucaccgaggagaaccagugggacuccgccaaggccgccgucgaggacgaggacuucuggaagcucguggaccgggagcgcgagcugcacaagcuggggaagugcggcagcugcguguacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgcggacgacacggccgggugggacacccgcaucaccgaggacgaccugcacaacgaggagaagaucacccagcagauggacccggagcaccggcagcucgccaacgccaucuucaagcugacguaccagaacaagguggugaagguccagcgccccacccccaccggcaccgugauggacaucaucagccggaaggaccagcgcggcuccggccaggugggcaccuacgggcugaacacguucaccaacauggaggcccagcucauccggcagauggagggcgaggggguccugagcaaggcggaccuggagaacccccaccucccggagaagaagaucacccaguggcuggagaccaagggcguggagcgccugaagcggauggccaucuccggcgacgacugcguggucaagcccaucgacgaccgcuucgccaacgcccucguggcccugaacgacauggggaaggugcggaaggacaucccccaguggcagcccagcaagggcuggcacgacuggcagcaggucccguucugcucccaccacuuccacgagcugaucaugaaggacgggcgcaagcucguggugcccugccggccccaggacgagcugaucggccgcgcgcgcaucagccagggggccggcuggucccugcgggagacggccugccucggcaaggccuacgcgcagauguggagccugauguacuuccaccgccgggaccugcgccucgccuccaacgccaucugcagcgccguccccgugcacugggugccgaccucccggaccaccuggagcauccacgcccaccaccaguggaugacgaccgaggacaugcugaccgucuggaaccgcguguggaucgaggacaaccccuggauggaggacaagacccccgugacgaccugggagaacguccccuaccuggggaagcgggaggaccaguggugcggcagccucaucgggcugaccucccgcgcgaccugggcccagaacaucccgacggccauccagcagguccggagccugaucggcaacgaggaguuccucgacuacaugcccuccaugaagcgcuuccggaaggaggaggagagcgagggggccaucugguga

SEQ ID NO: 9899 - RNA, 9873 nt, Artificial Sequence
  derived and/or modified CDS sequence (opt1) from DENV-3__GU131871__SS-prME
accagccucugccucgugaugauccugcccgccgcccuggcguuccaccucaccagccgggacggcgagccgcggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggucaccuacgggacgugcaaccaggccggcgagcggcgccgggacaagcgcuccguggcccucgcgccccacgugggcauggggcuggacacccggacccagaccuggaugagcgccgagggcgccuggcgccaggucgagaagguggagacgugggcccugcggcacccgggguucaccauccucgcgcuguuccuggcccacuacaucggcaccucccucacccagaagguggucaucuucauccugcugaugcucgugacgcccagcaugaccaugcgcugcgugggggucggcaaccgggacuucguggagggccuguccggggccaccuggguggacgucgugcuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccguccugccggaggagcaggaccagaacuacgugugcaagcacaccuacguggaccgcggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccaccggcgccaccacggagacccccaccuggaaccggaaggagcuccuggucaccuucaagaacgcccacgccaagaagcaggagguggugguccuggggagccaggagggcgcgaugcacacggcccucaccggggccaccgagauccagaacuccggcgggaccagcaucuucgccggccaccugaagugccgccugaagauggacaagcucgagcugaagggcauguccuacgccaugugcacgaacaccuucgugcugaagaaggaggugagcgagacccagcacgggaccauccucaucaaggucgaguaccggggcgaggacgcgccgugcaagauccccuucuccacggaggacgggcagggcaaggcccacaacggccgccugaucaccgccaaccccguggugaccaagaaggaggagcccgucaacaucgaggccgagccgcccuucggggagagcaacaucgugaucggcaucggggacaacgcgcugaagaucaacugguacaagaagggcagcuccaucgggaagauguucgaggccaccgcccggggcgcccgccgcauggccauccugggcgacacggcgugggacuucgggagcgugggcgggguccucaacucccugggcaagauggugcaccagaucuucgggagcgccuacaccgcccuguucuccggcgugagcugggucaugaagaucggcaucgggauccuccugaccuggaucggccugaacuccaagaacaccagcauguccuucagcugcaucgccaucgggaucaucacgcucuaccugggcgccguggugcaggcggacauggggugcgucaucaacuggaagggcaaggagcugaagugcggcuccgggaucuucgugaccaacgaggugcacaccuggaccgagcaguacaaguuccaggccgacagccccaagcggcucgccacggccaucgccggcgcgugggagaacggggucugcggcauccgcuccaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacagcuggaagaccugggggaaggccaagaucgugaccgccgagacgcagaacuccagcuucaucaucgacggccccaacacccccgagugccccuccgcgagccgggccuggaacgucugggagguggaggacuacggguucggcguguucaccaccaacaucuggcucaagcugcgcgaggucuacacccagcugugcgaccaccggcucauguccgccgccgugaaggacgagcgcgccgugcacgcggacaugggcuacuggaucgagagccagaagaacgggagcuggaagcuggagaaggccucccugaucgaggucaagacgugcaccuggcccaagucccacacccucugguccaacggcgugcuggagagcgacaugaucauccccaagucccuggccgggcccaucagccagcacaaccaccggccgggcuaccacacccagacggccgggcccuggcaccucggcaagcuggagcuggacuucaacuacugcgagggcaccaccguggucaucaccgagaacugcgggacgcgcggccccucccuccggaccaccaccgugagcgggaagcugauccacgaguggugcugccgcuccugcacgcugcccccgcuccgguacaugggcgaggacgggugcugguacggcauggagauccgccccaucagcgagaaggaggagaacauggugaagucccuggucagcgccggcuccgggaagguggacaacuucaccaugggcgugcugugccucgcgauccuguucgaggaggucaugcgggggaaguucggcaagaagcacaugaucgccgggguguucuucaccuucgugcugcuccugagcggccagaucaccuggcgcgacaugacgcacacccugaucaugaucggcuccaacgccagcgaccggauggggaugggcgucaccuaccucgcccugaucgccaccuucaagauccagcccuuccuggcgcucggguucuuccugcgcaagcugacgucccgggagaaccuccugcugggcgugggccucgccauggccaccacccugcagcugcccgaggacaucgagcagauggccaacgggaucgcgcucggccugauggcccugaagcucaucacccaguucgagacguaccagcuguggaccgcccugaucagccugaccugcagcaacaccauguucacgcugaccguggccuggcgcaccgccacccugauccucgcgggggucucccugcugccggugugccagagcuccagcaugcgcaagacggacuggcuccccauggccgucgccgccaugggcgugccgccccucccgcuguucaucuucucccucaaggacacccugaagcggcgcagcuggccccugaacgagggggugauggccgucggccucguguccauccuggcgagcucccugcuccggaacgacgugcccauggccggcccccuggucgccgggggccugcucaucgccugcuacgugaucaccgggaccagcgccgaccugacgguggagaaggcggccgacaucaccugggaggaggaggccgagcagaccggcgucucccacaaccugaugaucaccguggacgacgacgggaccaugcgcaucaaggacgacgagacggagaacauccucaccgugcugcugaagaccgcccuccugaucgucagcggcguguucccguacuccauccccgccacccugcucguguggcacacguggcagaagcagacccagcggagcggcguccugugggacgugcccagcccgcccgagacccagaaggcggagcuggaggaggggguguaccgcaucaagcagcagggcaucuucgggaagacccaggucggcgugggggugcagaaggagggcgucuuccacacgauguggcacgugacccggggcgccgugcucaccuacaacgggaagcgccuggagcccaacugggccagcgucaagaaggaccugaucuccuacggcgggggcuggcggcucagcgcccaguggcagaagggggaggagguccaggugaucgcggucgagcccggcaagaaccccaagaacuuccagaccacgcccggcaccuuccagaccaccacgggggagaucggcgccaucgcccuggacuucaagcccgggaccuccggcagccccaucaucaaccgcgagggcaaggugguggggcuguacggcaacggggucgugaccaagaacggcggguacgugagcggcaucgcccagaccaacgccgagccggacggccccacgcccgagcuggaggaggagauguucaagaagcggaaccucaccaucauggaccugcaccccggguccggcaagacccgcaaguaccugccggcgaucauccgggaggccaucaagcgccggcuccgcacccugauccuggcccccacgcgggucguggccgccgagauggaggaggcgcucaaggggcugcccauccgcuaccagaccaccgccaccaagagcgagcacacgggccgggagaucguggaccugaugugccacgccaccuucaccaugcgccuccugucccccguccgggugccgaacuacaaccugaucaucauggacgaggcccacuucaccgaccccgccagcaucgcggcccgcggguacaucuccacgcgcgugggcaugggcgaggccgccgcgaucuucaugaccgccacgccgcccgggaccgccgacgccuucccgcagagcaacgcccccauccaggacgaggagcgggacauccccgagcgcuccuggaacagcggcaacgaguggaucacggacuucgcggggaagaccgucugguucgugcccuccaucaaggccggcaacgacaucgccaacugccuccggaagaacgggaagaaggugauccagcugagccgcaagaccuucgacaccgaguaccagaagacgaagcugaacgacugggacuucgucgugaccaccgacaucuccgagaugggcgccaacuucaaggccgaccgggugaucgacccgcgccggugccucaagcccgucauccugaccgacggccccgagcgcgugauccuggcggggcccaugccggugaccgccgccagcgccgcccagcggcgcggccgggucgggcgcaacccccagaaggagaacgaccaguacaucuucacgggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagagccggaagaccuucguggagcugaugcgccgcggggaccuccccguguggcuggcccacaaggucgccuccgagggcaucaaguacacggaccgcaaguggugcuucgacgggcagcggaacaaccagauccuggaggagaacauggacguggagaucuggaccaaggagggcgagaagaagaagcuccgcccccgcuggcuggacgcccggaccuacagcgacccgcuggcccucaaggaguucaaggacuucgcggccggccgcaaguccaucgcccuggaccuggucaccgagaucgggcgggugcccagccaccucgcccaccgcacgcggaacgcccuggacaaccuggugaugcuccacaccuccgagcacggcgggcgcgcguaccggcacgccgucgaggagcugcccgagaccauggagacccugcuccugcugggccucaugauccugcugaccggcggggccaugcuguuccugaucagcgggaaggggaucggcaagaccagcaucgggcugaucugcgugaucgccuccagcggcaugcucuggauggccgagaucccgcugcaguggaucgcguccgccaucgugcuggaguucuucaugaugguccuccugauccccgagcccgagaagcagcgcacgccccaggacaaccagcuggccuacguggugaucgggauccucacccuggccgccaucaucgcggccaacgagaugggccugcucgagacgaccaagcgggaccugggcaugagcaaggagccgggggucgugucccccaccagcuaccuggacguggaccuccaccccgccuccgccuggacccuguacgcggucgccacgaccgugaucacccccaugcugcgccacaccaucgagaacagcacggccaacgugucccucgccgccaucgcgaaccaggccgucgugcugaugggccuggacaagggguggccgaucagcaagauggaccucggcgugccccugcuggcccucgggugcuacucccaggucaacccccugacccugaccgccgccgugcuccugcugaucacccacuacgcgaucaucggccccggccuccaggccaaggccacgcgggaggcccagaagcgcaccgccgcggggaucaugaagaacccgaccguggacggcaucaugaccaucgaccuggaccccgucaucuacgacagcaaguucgagaagcagcugggccaggugaugcuccuggugcugugcgccguccagcuccugcugaugcggacguccugggcccucugcgaggcccugacccuggcgaccggccccaucaccacgcucugggagggcagccccgggaaguucuggaacaccaccaucgccguguccauggccaacaucuuccgcggcagcuaccuggccggggccggccuggcguucuccaucaugaaguccguggggaccggcaagcggggcaccgggucccagggcgagacgcucggggagaaguggaagcgcaagcugaaccagcugagccggaaggaguucgaccucuacaagaaguccggcaucaccgaggucgaccgcaccgaggccaaggaggggcugaagcggggcgagaucacccaccacgccgugucccgcggcagcgccaagcugcagugguucguggagcggaacauggucaucccggaggggcgcgugaucgaccucggcugcgggcgcggcgggugguccuacuacugcgccggccugaagaaggugacggagguccggggcuacaccaagggcgggcccgggcacgaggagcccgugcccaugagcaccuacggcuggaacaucgugaagcugauguccgggaaggacgucuucuaccucccgcccgagaagugcgacacccugcugugcgacaucggcgagagcucccccagccccacgguggaggagucccgcaccauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugagccggaacuccacccacgagauguacuggaucagcaacggcacggggaacaucguggcguccgugaacauggucagccgccuccugcugaaccgguucaccaugacccaccgccggccgaccaucgagaaggacguggaccucggcgccggcacgcgccacgugaacgccgagcccgagacccccaacauggacgucaucggggagcggaucaagcgcaucaaggaggagcacaacuccaccuggcacuacgacgacgagaacccguacaagaccugggccuaccacggcagcuacgaggugaaggccacgggguccgcgagcuccaugaucaacggcguggucaagcugcugaccaagcccugggacgugguccccauggugacccagauggccaugaccgacacgacccccuucgggcagcagcggguguucaaggagaaggucgacacccgcaccccgcggagcaugcccggcacgcgccgggugauggagaucaccgccgaguggcucuggcgcacccugggccgcaacaagaagccccggcugugcacccgcgaggaguucacgaagaaggugcggaccaacgccgcgaugggggccgucuucaccgaggagaaccagugggacagcgccaaggccgccguggaggacgaggacuucuggaagcucguggaccgcgagcgggagcugcacaagcugggcaagugcggguccugcgucuacaacaugaugggcaagcgcgagaagaagcucggggaguucggcaaggcgaagggcagccgggccaucugguacauguggcugggggcccgcuaccuggaguucgaggcccucggcuuccugaacgaggaccacugguucucccgggagaacagcuacuccgggguggagggcgaggggcugcacaagcucggcuacauccugcgcgacaucagcaagauccccggcggggccauguacgcggacgacaccgccggcugggacacgcggaucaccgaggacgaccugcacaacgaggagaagaucacccagcagauggacccggagcaccgccagcucgccaacgccaucuucaagcugaccuaccagaacaagguggucaaggugcagcggcccacccccacggggaccgugauggacaucaucucccgcaaggaccagcggggcagcggccaggucgggaccuacggccugaacaccuucacgaacauggaggcccagcucauccgccagauggagggggagggcgugcuguccaaggcggaccuggagaacccccaccucccggagaagaagaucacccaguggcuggagaccaaggggguggagcggcugaagcgcauggccaucagcggcgacgacugcgucgugaagcccaucgacgaccgguucgccaacgcccuccuggcccugaacgacaugggcaaggugcgcaaggacaucccccaguggcagcccuccaagggguggcacgacuggcagcaggucccguucugcagccaccacuuccacgagcucaucaugaaggacggccggaagcugguggugcccugccgcccccaggacgagcugaucgggcgcgcgcggaucucccagggcgccggguggagccuccgcgagaccgccugccugggcaaggccuacgcgcagauguggucccugauguacuuccaccggcgcgaccuccggcuggccagcaacgccaucugcuccgccguccccgugcacugggugccgacgagccgcaccaccugguccauccacgcccaccaccaguggaugaccacggaggacaugcugaccgucuggaaccggguguggaucgaggacaaccccuggauggaggacaagacccccgugaccacgugggagaacguccccuaccucggcaagcgcgaggaccaguggugcgggagccugaucggccugaccagccgggcgaccugggcccagaacaucccgaccgccauccagcagguccgcucccucaucgggaacgaggaguuccuggacuacaugcccagcaugaagcgguuccgcaaggaggaggaguccgagggcgccaucugguga

SEQ ID NO: 9900 - RNA, 9873 nt, Artificial Sequence
  derived and/or modified CDS sequence (opt1) from DENV-3__GU131872__SS-prME
accagccucugccucgugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccaggucgagaagguggagacgugggcccugcggcacccgggguucaccauccucgcgcuguuccuggcccacuacaucggcaccucccucacccagaagguggucaucuucauccugcugaugcucgugacgcccagcaugaccaugcgcugcgugggggucggcaaccgggacuucguggagggccuguccggggccaccuggguggacgucgugcuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccguccugccggaggagcaggaccagaacuacgugugcaagcacaccuacguggaccgcggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucgugcugaagaaggagguguccgagacccagcacgggaccauccucaucaaggucgaguaccggggcgaggacgcgccgugcaagauccccuucagcaccgaggacgggcagggcaaggcccacaacggccgccugaucacggccaaccccguggugaccaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcgggguccucaacagccugggcaagauggugcaccagaucuucggguccgccuacacggcccuguucagcggcguguccugggucaugaagaucggcaucgggauccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcggcucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagauggugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacaugacccacacgcugaucaugaucggcagcaacgccuccgaccggauggggaugggcgucaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccauguucacccugacgguggccuggcgcaccgccacccugauccucgcgggggucagccugcugccggugugccaguccagcuccaugcgcaagaccgacuggcuccccauggccgucgccgccaugggcgugccgccccucccgcuguucaucuucagccucaaggacacgcugaagcggcgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugaccguggagaaggcggccgacaucacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcguguucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccacccccggcacguuccagaccaccaccggggagaucggcgccaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucauccgggaggccaucaagcgccggcuccgcacccugauccuggcccccacccgggucguggccgccgagauggaggaggcgcucaaggggcugcccauccgcuaccagacgaccgccaccaaguccgagcacaccggccgggagaucguggaccugaugugccacgccacguucaccaugcgccuccugagccccguccgggugccgaacuacaaccugaucaucauggacgaggcccacuucaccgaccccgccuccaucgcggcccgcggguacaucagcacccgcgugggcaugggcgaggccgccgcgaucuucaugacggccacgccgcccgggaccgccgacgccuucccgcaguccaacgcccccauccaggacgaggagcgggacauccccgagcgcagcuggaacuccggcaacgaguggaucaccgacuucgcggggaagacggucugguucgugcccagcaucaaggccggcaacgacaucgccaacugccuccggaagaacgggaagaaggugauccagcugucccgcaagaccuucgacaccgaguaccagaagaccaagcugaacgacugggacuucgucgugacgaccgacaucagcgagaugggcgccaacuucaaggccgaccgggugaucgacccgcgccggugccucaagcccgucauccugaccgacggccccgagcgcgugauccuggcggggcccaugccggugaccgccgccuccgccgcccagcggcgcggccgggucgggcgcaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgggagaaguccgccgcgaucgacggcgaguaccgccugaagggcgagucccggaagaccuucguggagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggacgaaggagggcgagaagaagaagcuccgcccccgcuggcuggacgcccggaccuacuccgacccgcuggcccucaaggaguucaaggacuucgcggccggccgcaagagcaucgcccuggaccuggucaccgagaucgggcgggugcccucccaccucgcccaccgcacccggaacgcccuggacaaccuggugaugcuccacacgagcgagcacggcgggcgcgcguaccggcacgccgucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucgugcuggaguucuucaugaugguccuccugauccccgagcccgagaagcagcgcacgccccaggacaaccagcuggccuacguggugaucgggauccucacccuggccgccaucaucgcggccaacgagaugggccugcucgagaccacgaagcgggaccugggcauguccaaggagccgggggucgugagccccaccuccuaccuggacguggaccuccaccccgccagcgccuggacccuguacgcggucgccaccacggugaucacccccaugcugcgccacaccaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacgcugaccgccgccgugcuccugcugaucacccacuacgcgaucaucggccccggccuccaggccaaggccacccgggaggcccagaagcgcacggccgcggggaucaugaagaacccgaccguggacggcaucaugaccaucgaccuggaccccgucaucuacgacuccaaguucgagaagcagcugggccaggugaugcuccuggugcugugcgccguccagcuccugcugaugcggaccagcugggcccucugcgaggcccugacgcuggcgaccggccccaucaccacccucugggagggcucccccgggaaguucuggaacacgaccaucgccgugagcauggccaacaucuuccgcggcuccuaccuggccggggccggccuggcguucagcaucaugaaguccguggggaccggcaagcggggcaccgggagccagggcgagacccucggggagaaguggaagaagaagcugaaccagcugagccgcaaggaguucgaccucuacaagaaguccggcaucacggaggucgaccggaccgaggccaaggaggggcugaagcgcggcgagaucacccaccacgccgugagccggggcuccgccaagcugcagugguucguggagcgcaacauggucaucccggaggggcgggugaucgaccucggcugcgggcgcggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccggacgauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugucccgcaacagcacccacgagauguacuggaucuccaacggcaccgggaacaucguggcgagcgugaacauggucucccggcuccugcugaaccgcuucacgaugacccaccggcgcccgaccaucgagaaggacguggaccucggcgccggcacccggcacgugaacgccgagcccgagacgcccaacauggacgucaucggggagcgcaucaagcggaucaaggaggagcacaacagcaccuggcacuacgacgacgagaacccguacaagaccugggccuaccacggcuccuacgaggugaaggccaccgggagcgcguccagcaugaucaacggcguggucaagcugcugacgaagcccugggacgugguccccauggugacccagauggccaugaccgacaccacgcccuucgggcagcagcgcguguucaaggagaaggucgacacccggaccccgcgcagcaugcccggcacccggcgcgugauggagaucacggccgaguggcucuggcggacccugggccgcaacaagaagccccgccugugcacccgggaggaguucaccaagaaggugcgcacgaacgccgcgaugggggccgucuucaccgaggagaaccagugggacuccgccaaggccgccguggaggacgaggacuucuggaagcucguggaccgggagcgcgagcugcacaagcugggcaagugcgggagcugcgucuacaacaugaugggcaagcgggagaagaagcucggggaguucggcaaggcgaagggcucccgcgccaucugguacauguggcugggggcccgguaccuggaguucgaggcccucggcuuccugaacgaggaccacugguucagccgcgagaacuccuacagcgggguggagggcgaggggcugcacaagcucggcuacauccugcgggacaucuccaagauccccggcggggccauguacgcggacgacaccgccggcugggacacccgcaucacggaggacgaccugcacaacgaggagaagaucacccagcagauggacccggagcaccggcagcucgccaacgccaucuucaagcugaccuaccagaacaagguggucaaggugcagcgccccacccccaccgggacggugauggacaucaucagccggaaggaccagcgcggcuccggccaggucgggaccuacggccugaacaccuucaccaacauggaggcccagcucauccggcagauggagggggagggcgugcugagcaaggcggaccuggagaacccccaccucccggagaagaagaucacgcaguggcuggagaccaaggggguggagcgccugaagcggauggccaucuccggcgacgacugcgucgugaagcccaucgacgaccgcuucgccaacgcccuccuggcccugaacgacaugggcaaggugcggaaggacaucccccaguggcagcccagcaagggguggcacgacuggcagcaggucccguucugcucccaccacuuccacgagcucaucaugaaggacggccgcaagcugguggugcccugccggccccaggacgagcugaucgggcgcgcgcgcaucagccagggcgccggguggucccuccgggagaccgccugccugggcaaggccuacgcgcagauguggagccugauguacuuccaccgccgggaccuccgccuggccuccaacgccaucugcagcgccguccccgugcacugggugccgaccucccggacgaccuggagcauccacgcccaccaccaguggaugaccaccgaggacaugcugacggucuggaaccgcguguggaucgaggacaaccccuggauggaggacaagacccccgugaccaccugggagaacguccccuaccucggcaagcgggaggaccaguggugcgggagccugaucggccugacgucccgcgcgaccugggcccagaacaucccgaccgccauccagcagguccggagccucaucgggaacgaggaguuccuggacuacaugcccuccaugaagcgcuuccggaaggaggaggagagcgagggcgccaucugguga

SEQ ID NO: 9901 - RNA, 9873 nt, Artificial Sequence
  derived and/or modified CDS sequence (opt1) from DENV-3__GU131873__SS-prME
accagccugugccucaugaugauccugcccgccgcccuggcguuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcaccccggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcucaucgagggcaaggucgugcaguacgagaaccugaaguacaccguggucaucacggugcacaccggggaccagcaccaggucggcaacgagacccaggggaucaccgccgagaucacgccccaggccagcaccaccgaggcgauccugcccgaguacggcacccucgggcuggagugcagcccccggaccggccuggacuucaacgagaugauccuccugacgaugaagaacaaggccuggauggugcaccgccagugguucuucgaccugccgcuccccuggaccagcggcgccaccaccgagacgcccaccuggaaccggaaggagcugcuggugaccuucaagaacgcccacgccaagaagcaggaggucguggugcucgggucccaggagggcgcgaugcacaccgcccugacgggggccaccgagauccagaacagcggcgggaccuccaucuucgccggccaccugaagugccgccucaagauggacaagcuggagcugaagggcaugagcuacgccaugugcaccaacacguucguccucaagaaggagguguccgagacccagcacgggaccauccugaucaagguggaguacaagggcgaggacgcgcccugcaagaucccguucagcaccgaggacgggcagggcaaggcccacaacggccggcugaucacggccaaccccgucgugaccaagaaggaggagcccgugaacaucgaggccgagcccccguucggggagagcaacaucgucaucggcaucggggacaacgcgcugaagaucaacugguacaagaagggcuccagcaucgggaagauguucgaggccaccgcccgcggcgcccggcgcauggccauccucggcgacaccgcgugggacuucggguccgugggcggggugcugaacagccugggcaagaugguccaccagaucuucggguccgccuacacggcccucuucagcggcguguccugggugaugaagaucggcaucgggguccugcugaccuggaucggccucaacagcaagaacaccuccaugagcuucuccugcaucgccaucgggaucaucacccuguaccugggcgccguggugcaggcggacauggggugcgucaucaacuggaagggcaaggagcucaagugcggcagcgggaucuucgugacgaacgaggugcacaccuggaccgagcaguacaaguuccaggccgacucccccaagcgccuggccaccgccaucgccggcgcgugggagaacggggucugcggcauccggagcacgacccgcauggagaaccugcucuggaagcagaucgccaacgagcugaacuacauccugugggagaacaacaucaagcucaccgugguggucggggacaucaucggcgugcuggagcagggcaagcggacccugacgccccagcccauggagcucaaguacuccuggaagaccugggggaaggccaagaucgugaccgccgagacccagaacagcuccuucaucaucgacggcccgaacacgcccgagugccccagcgcgucccgcgccuggaacgucugggagguggaggacuacggguucggcguguucaccaccaacaucuggcugaagcugcgggaggucuacacccagcucugcgaccaccgccugaugagcgccgccgugaaggacgagcgggccgugcacgcggacaugggcuacuggaucgagagccagaagaacggguccuggaagcuggagaaggccagccucaucgaggucaagaccugcacguggcccaagucccacacccuguggagcaacggcgugcuggaguccgacaugaucauccccaagucccucgccgggcccaucucccagcacaaccaccgccccggcuaccacacccagaccgccgggccguggcaccugggcaagcuggagcucgacuucaacuacugcgagggcacgaccguggucaucaccgagaacugcgggacccggggccccagccugcgcacgaccaccguguccgggaagcugauccacgaguggugcugccggagcugcacccugccgccccuccgcuacaugggcgaggacgggugcugguacggcauggagauccggccgaucuccgagaaggaggagaacauggucaagagccuggucuccgccggcagcgggaagguggacaacuucacgaugggcgugcucugccuggcgauccuguucgaggaggucaugcgcgggaaguucggcaagaagcacaugaucgccgggguguucuucaccuucgugcuccugcuguccggccagaucaccuggcgggacauggcccacacccucaucaugaucggcagcaacgccuccgaccgcauggggaugggcgucacguaccuggcccugaucgcgaccuucaagauccagcccuuccucgcccugggguucuuccugcggaagcucaccagccgcgagaaccugcugcucggcgugggccuggccauggccaccacgcugcagcuccccgaggacaucgagcagauggcgaacgggaucgcccugggccugauggcccucaagcugaucacccaguucgagaccuaccagcuguggaccgcccucaucagccugacgugcuccaacaccauguucacccugaccguggccuggcggacggcgacccucauccuggccggggucagccugcuccccgugugccaguccagcuccaugcgcaagaccgacuggcugccgauggccgucgccgccaugggcgugccgccccugccccucuucaucuucagccugaaggacacccugaagcgccgguccuggccgcucaacgagggggugauggcggucggccuggugagcauccuggccuccagccuccugcgcaacgacgugcccauggccggcccccuggucgccgggggccuccugaucgccugcuacgugaucacggggaccuccgcggaccugaccguggagaaggccgccgacaucaccugggaggaggaggccgagcagacgggcgucagccacaaccucaugaucaccguggacgacgacgggaccaugcggaucaaggacgacgagaccgagaacauccugaccgugcugcucaagacggcccugcugaucgucuccggcguguuccccuacagcaucccggcgacccuccugguguggcacaccuggcagaagcagacccagcgcuccggcguccugugggacgugcccuccccgcccgagacgcagaaggccgagcucgaggaggggguguaccggaucaagcagcagggcaucuucgggaagacccaggucggcgugggggugcagaaggagggcgucuuccacaccauguggcacgugacccgcggcgccgugcugacguacaacgggaagcggcuggagccgaacugggccuccgucaagaaggaccucaucagcuacggcgggggcuggcgccuguccgcgcaguggcagaagggggaggagguccaggugaucgccgucgagcccggcaagaaccccaagaacuuccagaccaugcccggcaccuuccagaccacgaccggggagaucggcgccaucgcccuggacuucaagccggggaccagcggcagccccaucaucaaccgggagggcaaggugguggggcuguacggcaacggggucgugaccaagaacggcggguacguguccggcaucgcccagacgaacgcggagcccgacggcccgacccccgagcucgaggaggagauguucaagaagcgcaaccugaccaucauggaccugcaccccgggagcggcaagacccggaaguaccuccccgccaucguccgcgaggccaucaagcggcgccugcggacgcugauccucgccccgacccgcgugguggccgcggagauggaggaggcccugaaggggcugcccauccgguaccagaccaccgccacgaaguccgagcacaccggccgcgagaucgucgaccucaugugccacgccaccuucaccaugcggcugcugagccccgugcgcgugcccaacuacaaccucaucaucauggacgaggcccacuucacggacccggcguccaucgccgcccggggguacaucagcacccgcgucggcaugggcgaggccgcggccaucuucaugaccgccacgccgcccgggacggccgacgccuucccccaguccaacgcgccgauccaggacgaggagcgcgacauccccgagcggagcuggaacuccggcaacgaguggaucaccgacuucgccgggaagaccgugugguucgugcccagcaucaaggccggcaacgacaucgccaacugccugcgcaagaacgggaagaaggucauccagcugucccggaagaccuucgacacggaguaccagaagaccaagcucaacgacugggacuucguggugaccaccgacaucagcgagaugggcgccaacuucaaggcggaccgcgucaucgacccccggcgcugccugaagccggugauccugacggacggccccgagcgggugauccucgccgggcccaugcccgucaccgccgccuccgccgcgcagcgccggggccgcguggggcggaacccgcagaaggagaacgaccaguacaucuucaccggccagccccugaacaacgacgaggaccacgcccacuggaccgaggccaagaugcugcucgacaacgugaacacccccgaggggaucauccccgcccuguucgagccggagcgcgagaaguccgcggccaucgacggcgaguaccggcugaagggcgagucccgcaagacguucgucgagcucaugcggcgcggggaccugcccguguggcuggcccacaaggucgccagcgagggcaucaaguacaccgaccggaaguggugcuucgacgggcagcgcaacaaccagauccucgaggagaacauggacguggagaucuggaccaaggagggcgagaagaagaagcugcggccccgcuggcuggacgcccgcaccuacuccgacccccucgcgcugaaggaguucaaggacuucgccgccggccgcaagagcaucgcccuggaccucgugacggagaucgggcgcgucccgucccaccuggcccaccggacccgcaacgcgcuggacaaccucgugaugcugcacaccagcgagcacggcgggcgggccuaccgccacgccguggaggagcugcccgagaccauggagacgcuccugcugcucggccugaugauccugcucaccgggggcgccaugcuguucaucaucagcggcaaggggaucggcaagaccuccaucgggcugaucugcgucaucgccagcuccggcaugcucuggauggcggagaucccccugcaguggaucgccagcgccaucgugcuggaguucuucaugauggugcuccugaucccggagcccgagaagcagcggacgccccaggacaaccagcuggccuacgucgugaucgggauccucacgcuggccgcgaucaucgccgccaacgagaugggccugcucgagaccaccaagcgcgaccugggcauguccaaggagcccgggguggucagcccgaccuccuaccuggacguggaccuccaccccgccagcgcguggacgcuguacgccguggccaccaccgucaucacccccaugcugcggcacacgaucgagaacuccaccgccaacgugagccucgccgcgaucgccaaccaggccgugguccugaugggccuggacaagggguggcccaucuccaagauggaccucggcgugccgcugcuggcccucgggugcuacagccaggugaacccccugacccugaccgccgcgguccuccugcugaucacgcacuacgccaucaucggccccggccuccaggccaaggccacccgcgaggcccagaagcggaccgcggccgggaucaugaagaaccccaccguggacggcaucaugacgaucgaccuggacccggugaucuacgacuccaaguucgagaagcagcuggggcaggucaugcuccuggugcugugcgccgugcagcuccugcugaugcgcaccagcugggcccucugcgaggcgcugacccuggccaccggccccaucacgacccucugggagggcucccccgggaaguucuggaacaccaccaucgccgucagcauggccaacaucuuccggggcuccuaccuggccggggcgggccuggccuucagcaucaugaaguccguggggacgggcaagcgcggcaccgggagccagggcgagacccucggggagaaguggaagaagaagcugaaccagcugagccggaaggaguucgaccucuacaagaaguccggcaucaccgagguggaccgcaccgaggccaaggaggggcugaagcggggcgagaucacgcaccacgccgucagccgcggcuccgccaagcugcagugguucguggagcggaacauggugauccccgaggggcgcgucaucgaccucggcugcgggcggggcggguggagcuacuacugcgcgggccugaagaaggugaccgaggugcgcggcuacaccaagggcgggccggggcacgaggagcccguccccauguccaccuacggcuggaacaucgugaagcugaugagcgggaaggacguguucuaccucccgcccgagaagugcgacacgcugcugugcgacaucggcgaguccagccccucccccaccgucgaggagagccgcaccauccgggugcugaagaugguggagcccuggcucaagaacaaccaguucugcaucaagguccugaaccccuacaugcccaccgugaucgagcaccuggagcgccuccagcggaagcacggcgggaugcuggugcgcaacccccugucccggaacagcacgcacgagauguacuggaucuccaacggcaccgggaacaucgucgccagcgugaacauggugucccgccuccugcugaaccgguucaccaugacccaccgccggcccacgaucgagaaggacgucgaccucggcgccggcacccgccacgugaacgccgagccggagacccccaacauggacgugaucggggagcggaucaagcgcaucaaggaggagcacaacagcaccuggcacuacgacgacgagaaccccuacaagacgugggccuaccacggcuccuacgaggucaaggcgaccgggagcgccuccagcaugaucaacggcguggucaagcugcugaccaagccgugggacguggugcccauggucacccagauggccaugacggacaccacccccuucgggcagcagcggguguucaaggagaagguggacacccgcacgccccggagcaugccgggcacccgccgggucaugggcaucaccgccgaguggcucuggcgcacccuggggcggaacaagaagccccgccugugcacgcgcgaggaguucaccaagaaggugcggaccaacgcggccaugggcgccguguucaccgaggagaaccagugggacuccgccaaggccgcggucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggccaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgcgauguacgccgacgacacggccgggugggacacccggaucaccgaggacgaccugcacaacgaggagaagaucacccagcagauggaccccgagcaccgccagcucgccaacgccaucuucaagcugacguaccagaacaagguggugaagguccagcggccgacccccaccggcaccgugauggacaucaucagccgcaaggaccagcggggcuccggccaggugggcaccuacgggcugaacacguucaccaacauggaggcgcagcucauccgccagauggagggcgaggggguccugagcaaggccgaccuggagaacccccaccuccccgagaagaagaucacccaguggcuggagaccaagggcguggagcggcugaagcgcauggccaucuccggcgacgacugcguggucaagccgaucgacgaccgguucgccaacgcccuccuggcgcugaacgacauggggaaggugcgcaaggacaucccccaguggcagcccagcaagggcuggcacgacuggcagcagguccccuucugcucccaccacuuccacgagcucaucaugaaggacgggcggaagcuggucgugccgugccgcccccaggacgagcugaucggccgggcccgcaucagccagggggccggcuggucccuccgcgagacggccugccugggcaaggcguacgcccagauguggagccugauguacuuccaccggcgcgaccuccggcuggccuccaacgccaucugcagcgccgugcccguccacugggugcccaccucccgcaccaccuggagcauccacgcgcaccaccaguggaugacgaccgaggacaugcugaccguguggaaccgggucuggaucgaggacaacccguggauggaggacaagacccccgugacgaccugggagaacgugcccuaccucgggaagcgcgaggaccaguggugcggcagccugaucgggcugaccucccgggccaccugggcccagaacauccccacggccauccagcagguccgcagccucaucggcaacgaggaguuccuggacuacaugccguccaugaagcgguuccgcaaggaggaggagagcgagggggccaucugguga

SEQ ID NO: 9902 - RNA, 9873 nt, Artificial Sequence
  derived and/or modified CDS sequence (opt1) from DENV-3__GU131874__SS-prME
accagccugugccugaugaugauccugcccgccgcccuggcguuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcaccccggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugcccgaggagcaggaccagaacuacgucugcaagcacaccuacguggaccgcggguggggcaacgggugcggccucuucgggaagggcucccuggugaccugcgccaaguuccagugccuggagcucaucgagggcaaggucgugcaguacgagaaccugaaguacaccgugaucaucacgguccacaccggggaccagcaccaggugggcaacgagacccagggggucaccgccgagaucacgccccaggccagcaccaccgaggcgauccugcccgaguacggcacccucgggcuggagugcagcccccggaccggccuggacuucaacgagaugauccuccugacgaugaagaacaaggccuggauggugcaccgccagugguucuucgaccugccgcuccccuggaccagcggcgccaccaccgagacgcccaccuggaaccggaaggagcugcuggugaccuucaagaacgcccacgccaagaagcaggaggucguggugcucgggucccaggagggcgcgaugcacaccgcccugacgggggccaccgagauccagaacagcggcgggaccuccaucuucgccggccaccugaagugccgccucaagauggacaagcuggagcugaagggcaugagcuacgccaugugcaccaacacguucguccucaagaaggagguguccgagacccagcacgggaccauccugaucaagguggaguacaagggcgaggacgcgcccugcaagaucccguucagcaccgaggacgggcagggcaaggcccacaacggccggcugaucacggccaaccccgucgugaccaagaaggaggagcccgugaacaucgaggccgagcccccguucggggagagcaacaucgucaucggcaccggggacaacgcgcugaagaucaacugguacaagaagggcuccagcaucgggaagauguucgaggccaccgcccgcggcgcccggcgcauggccauccucggcgacacggcgugggacuucggguccgugggcggggugcugaacagccugggcaagaugguccaccagaucuucggguccgccuacaccgcccucuucagcggcguguccugggugaugaagaucggcaucgggguccugcugaccuggaucggccucaacagcaagaacaccuccaugagcuucuccugcaucgccaucgggaucaucacgcuguaccugggcgccguggugcaggcggacauggggugcgucaucaacuggaagggcaaggagcucaagugcggcagcgggaucuucgugaccaacgaggugcacaccuggaccgagcaguacaaguuccaggccgacucccccaagcgccuggccacggccaucgccggcgcgugggagaacggggucugcggcauccggagcaccacccgcauggagaaccugcucuggaagcagaucgccaacgagcugaacuacauccugugggagaacaacaucaagcucaccgugguggucggggacaucaucggcgugcuggagcagggcaagcggacgcugacgccccagcccauggagcucaaguacuccuggaagaccugggggaaggccaagaucgugaccgccgagacgcagaacagcuccuucaucaucgacggcccgaacacccccgagugccccagcaccucccgcgcguggaacgucugggagguggaggacuacggguucggcguguucaccaccaacaucuggcugaagcugcgggaggucuacacgcagcucugcgaccaccgccugaugagcgccgccgugaaggacgagcgggccgugcacgccgacaugggcuacuggaucgagagccagaagaacggguccuggaagcuggagaaggcgagccucaucgaggucaagaccugcaccuggcccaagucccacacccuguggagcaacggcgugcuggaguccgacaugaucauccccaagucccucgccgggcccaucucccagcacaaccaccgccccggcuaccacacgcagaccgccgggccguggcaccugggcaagcuggagcucgacuucaacuacugcgagggcaccaccguggucaucacggagaacugcgggacccggggccccagccugcgcaccaccacgguguccgggaagcugauccacgaguggugcugccggagcugcacccugccgccccuccgcuacaugggcgaggacgggugcugguacggcauggagauccggccgaucuccgagaaggaggagaacauggucaagagccuggucuccgccggcagcgggaagguggacaacuucaccaugggcgugcucugccuggccauccuguucgaggaggucaugcgcgggaaguucggcaagaagcacaugaucgcggggguguucuucaccuucgugcuccugcuguccggccagaucacguggcgggacauggcccacacccucaucaugaucggcagcaacgccuccgaccgcauggggaugggcgucaccuaccuggcccugaucgccaccuucaagauccagcccuuccucgcgcugggguucuuccugcggaagcucacgagccgcgagaaccugcugcucggcgugggccuggccauggccaccacccugcagcuccccgaggacaucgagcagauggccaacgggaucgcgcugggccugauggcccucaagcugaucacccaguucgagacguaccagcuguggaccgcccucaucagccugaccugcuccaacaccauguucacgcugaccguggccuggcggaccgccacccucauccuggcgggggucagccugcuccccgugugccaguccagcuccaugcgcaagacggacuggcugccgauggccgucgccgccaugggcgugccgccccugccccucuucaucuucagccugaaggacacccugaagcgccgguccuggccgcucaacgagggggugauggccgucggccuggugagcauccuggcguccagccuccugcgcaacgacgugcccauggccggcccccuggucgccgggggccuccugaucgccugcuacgugaucaccgggaccuccgccgaccugacgguggagaaggcggccgacaucaccugggaggaggaggccgagcagaccggcgucagccacaaccucaugaucaccguggacgacgacgggaccaugcggaucaaggacgacgagacggagaacauccugaccgugcugcucaagaccgcccugcugaucgucuccggcguguuccccuacagcaucccggccacccuccugguguggcacacguggcagaagcagacccagcgcuccggcguccugugggacgugcccuccccgcccgagacccagaaggcggagcucgaggaggggguguaccggaucaagcagcagggcaucuucgggaagacccaggucggcgugggggugcagaaggagggcgucuuccacacgauguggcacgugacccgcggcgccgugcugaccuacaacgggaagcggcuggagccgaacugggccuccgucaagaaggaccucaucagcuacggcgggggcuggcgccuguccgcccaguggcagaagggggaggagguccaggugaucgcggucgagcccggcaagaaccccaagaacuuccagaccaugcccggcacguuccagaccaccaccggggagaucggcgccaucgcccuggacuucaagccggggacgagcggcagccccaucaucaaccgggagggcaaggugguggggcuguacggcaacggggucgugaccaagaacggcggguacguguccggcaucgcccagaccaacgccgagcccgacggcccgacccccgagcucgaggaggagauguucaagaagcgcaaccugacgaucauggaccugcaccccgggagcggcaagacccggaaguaccuccccgcgaucguccgcgaggccaucaagcggcgccugcggacccugauccucgccccgacccgcgugguggccgccgagauggaggaggcgcugaaggggcugcccauccgguaccagacgaccgccaccaaguccgagcacaccggccgcgagaucgucgaccucaugugccacgccacguucaccaugcggcugcugagccccgugcgcgugcccaacuacaaccucaucaucauggacgaggcccacuucaccgacccggccuccaucgcggcccggggguacaucagcacccgcgucggcaugggcgaggccgccgcgaucuucaugacggccacgccgcccgggaccgccgacgccuucccccaguccaacgccccgauccaggacgaggagcgcgacauccccgagcggagcuggaacuccggcaacgaguggaucaccgacuucgcggggaagacggugugguucgugcccagcaucaaggccggcaacgacaucgccaacugccugcgcaagaacgggaagaaggucauccagcugucccggaagaccuucgacaccgaguaccagaagaccaagcucaacgacugggacuucguggugacgaccgacaucagcgagaugggcgccaacuucaaggccgaccgcgucaucgacccccggcgcugccugaagccggugauccugaccgacggccccgagcgggugauccucgcggggcccaugcccgucaccgccgccuccgccgcccagcgccggggccgcguggggcggaacccgcagaaggagaacgaccaguacaucuucaccggccagccccugaacaacgacgaggaccacgcgcacuggacggaggccaagaugcugcucgacaacaucaacacccccgaggggaucauccccgcccuguucgagccggagcgcgagaaguccgccgcgaucgacggcgaguaccggcugaagggcgagucccgcaagaccuucguggagcucaugcggcgcggggaccugcccgucuggcuggcccacaagguggccagcgagggcaucaaguacaccgaccggaaguggugcuucgacgggcagcgcaacaaccagauccucgaggagaacauggacgucgagaucuggacgaaggagggcgagaagaagaagcugcggccccgcuggcuggacgcccgcaccuacuccgacccccucgcccugaaggaguucaaggacuucgcggccggccgcaagagcaucgcccuggaccucgugaccgagaucgggcgcgugccgucccaccuggcccaccggacccgcaacgcccuggacaaccucgucaugcugcacacgagcgagcacggcgggcgggcguaccgccacgccguggaggagcugcccgagaccauggagacccuccugcugcucggccugaugauccugcucaccgggggcgccaugcuguuccugaucagcggcaaggggaucggcaagacguccaucgggcucaucugcgugaucgccagcuccggcaugcuguggauggccgagaucccccugcaguggaucgcgagcgccaucguccucgaguucuucaugauggugcugcugaucccggagcccgagaagcagcggacgccccaggacaaccagcucgccuacguggucaucgggauccugacccuggccgccaucaucgcggccaacgagaugggccuccuggagaccacgaagcgcgaccugggcauguccaaggagcccgggguggugagcccgaccuccuaccucgacgucgaccugcaccccgccagcgccuggacccuguacgcgguggccaccacggugaucacccccaugcuccggcacaccaucgagaacuccaccgccaacgucagccuggccgccaucgcgaaccaggccguggugcugaugggccucgacaagggguggcccaucuccaagauggaccugggcgucccgcugcucgcccuggggugcuacagccaggugaacccccugacgcucaccgccgccgugcugcugcucaucacccacuacgcgaucaucggccccggccugcaggccaaggccacccgcgaggcccagaagcggacggccgcggggaucaugaagaaccccaccgucgacggcaucaugaccaucgaccuggacccggugaucuacgacuccaaguucgagaagcagcucggccaggugaugcugcugguccucugcgccgcccagcugcugcucaugcgcaccagcugggcccugugcgaggcgcugacgcucgccaccggccccaucaccacccugugggagggcucccccgggaaguucuggaacacgaccaucgccgugagcauggccaacaucuuccggggcuccuaccuggccggggcgggccucgccuucagcaucaugaaguccguggggaccggcaagcgcggcaccgggagccagggcgagacccugggggagaaguggaagaagaagcugaaccagcucagccggaaggaguucgaccuguacaagaaguccggcaucacggaggucgaccgcaccgaggccaaggaggggcugaagcggggcgagaucacccaccacgccgugagccgcggcuccgccaagcuccagugguucguggagcggaacauggucauccccgaggggcgcgugaucgaccugggcugcgggcggggcggguggagcuacuacugcgcgggccugaagaaggugaccgagguccgcggcuacacgaagggcgggccggggcacgaggagcccgugcccauguccaccuacggcuggaacaucgugaagcucaugagcgggaaggacgucuucuaccugcccccggagaagugcgacacccugcugugcgacaucggcgaguccagccccucccccaccguggaggagagccgcacgauccgggugcucaagauggucgagcccuggcugaagaacaaccaguucugcaucaaggugcugaacccguacaugcccaccgugaucgagcaccucgagcgccugcagcggaagcacggcgggaugcugguccgcaacccccucucccggaacagcacccacgagauguacuggaucuccaacggcaccgggaacaucguggccagcgugaacauggucucccgccugcugcucaaccgguucacgaugacccaccgccggcccaccaucgagaaggacguggaccugggcgccggcacccgccacgugaacgccgagccggagacgcccaacauggacgucaucggggagcggaucaagcgcaucaaggaggagcacaacagcaccuggcacuacgacgacgagaaccccuacaagaccugggccuaccacggcuccuacgaggugaaggcgaccgggagcgccuccagcaugaucaacggcguggucaagcugcucacgaagccgugggacgugguccccauggugacccagauggccaugaccgacaccacgcccuucgggcagcagcggguguucaaggagaaggucgacacccgcacgccccggagcaugccgggcacccgccgggugaugggcaucaccgccgaguggcuguggcgcacccuggggcggaacaagcgcccccgccucugcacccgggaggaguucaccaagaaggugcgcacgaacgcggccaugggcgccgucuucaccgaggagaaccagugggacuccgccaaggccgcgguggaggacgaggacuucuggaagcugguggaccgggagcgcgagcugcacaagcucgggaagugcggcagcugcgucuacaacaugauggggaagcgggagaagaagcugggcgaguucggcaaggccaaggggucccgcgccaucugguacauguggcugggcgcccgguaccucgaguucgaggcccugggguuccugaacgaggaccacugguucagccgcgagaacuccuacagcggcguggagggggagggccuccacaagcugggcuacauccugcgggacaucuccaagauccccgggggcgcgauguacgccgacgacaccgccgggugggacacccgcaucacggaggacgaccuccacaacgaggagaagaucacccagcagauggaccccgagcaccggcagcuggccaacgccaucuucaagcugaccuaccagaacaagguggucaaggugcagcgcccgacccccaccggcacggugauggacaucaucagccggaaggaccagcgcggcuccgggcaggucggcaccuacgggcucaacaccuucaccaacauggaggcgcagcugauccggcagauggagggcgagggggugcugagcaaggccgaccucgagaacccccaccuccccgagaagaagaucgcccaguggcuggagacgaagggcguggagcgccucaagcggauggccaucuccggcgacgacugcgucgugaagccgaucgacgaccgcuucgccaacgcgcugcuggcccucaacgacauggggaaggugcggaaggacaucccccaguggcagcccagcaagggcuggcacgacuggcagcagguccccuucugcucccaccacuuccacgagcugaucaugaaggacgggcgcaagcugguggugccgugccggccccaggacgagcucaucggccgcgcccgcaucagccagggguccggcuggagccugcgggagaccgccugccugggcaaggcguacgcccagauguggucccucauguacuuccaccgccgggaccugcgccuggccagcaacgccaucugcuccgccguccccgugcacugggugcccaccagccggaccacguggagcauccacgcgcaccaccaguggaugaccaccgaggacaugcucgccgucuggaaccgcguguggaucgaggacaacccguggauggaggacaagacccccgugacgaccugggagaacguccccuaccuggggaagcgggaggaccaguggugcggcucccugaucgggcucaccagccgcgccaccugggcccagaacauccccacggccauccagcagguccggucccugaucggcaacgaggaguuccuggacuacaugccgagcaugaagcgcuuccggaaggaggaggaguccgagggggcgaucugguga

SEQ ID NO: 9903 - RNA, 9873 nt, Artificial Sequence
  derived and/or modified CDS sequence (opt1) from DENV-3__GU131875__SS-prME
accagccucugccucgugaugauccugcccgccgcccuggcguuccaccucaccagccgggacggggagccccggaugaucguggggaagaacgagcgcggcaagagccugcuguucaagacggccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggucaucuucauccugcugaugcucgugacgcccagcaugaccaugcgcugcgugggggucggcaaccgggacuucguggagggccuguccggggccaccuggguggacgucgugcuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccguccugccggaggagcaggaccagaacuacgugugcaagcacaccuacguggaccgcggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucgugcugaagaaggagguguccgagacccagcacgggaccauccucaucaaggucgaguaccggggcgaggacgcgccgugcaagauccccuucagcaccgaggacgggcagggcaaggcccacaacggccgccugaucacggccaaccccguggugaccaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcgggguccucaacagccugggcaagauggugcaccagaucuucggguccgccuacacggcccuguucagcggcguguccugggucaugaagaucggcaucgggauccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcggcucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacaugacccacacgcugaucaugaucggcagcaacgccuccgaccggauggggaugggcgucaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccauguucacccugacgguggccuggcgcaccgccacccugauccucgcgggggucagccugcugccggugugccaguccagcuccaugcgcaagaccgacuggcuccccauggccgucgccgccaugggcgugccgccccucccgcuguucaucuucagccucaaggacacgcugaagcggcgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugaccguggagaaggcggccgacaucacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcguguucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagacgaccaccggggagaucggcgccaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggcgaucauccgggaggccaucaagcgccggcuccgcacccugauccuggcccccacccgggucguggccgccgagauggaggaggcgcucaaggggcugcccauccgcuaccagaccacggccaccaaguccgagcacaccggccgggagaucguggaccugaugugccacgccaccuucacgaugcgccuccugagccccguccgggugccgaacuacaaccugaucaucauggacgaggcccacuucaccgaccccgccuccaucgcggcccgcggguacaucagcacccgcgugggcaugggcgaggccgccgcgaucuucaugaccgccacgccgcccgggaccgccgacgccuucccgcaguccaacgcccccauccaggacgaggagcgggacauccccgagcgcagcuggaacuccggcaacgaguggaucaccgacuucgcggggaagaccgucugguucgugcccagcaucaaggccggcaacgacaucgccaacugccuccggaagaacgggaagaaggugauccagcugucccgcaagacguucgacaccgaguaccagaagaccaagcugaacgacugggacuucgucgugaccacggacaucagcgagaugggcgccaacuucaagguggaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgcuggcuggacgcccggacguacuccgacccgcuggcccucaaggaguucaaggacuucgccgcgggccgcaagagcaucgcccuggaccuggugaccgagaucgggcgggugcccucccaccucgcccaccgcacccggaacgcccuggacaaccuggucaugcuccacaccagcgagcacggcgggcgcgccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagaccaccaagcgggaccugggcauguccaaggagccggggguggugagccccacguccuaccuggacgucgaccuccaccccgccagcgccuggacccuguacgccguggcgaccaccgugaucacgcccaugcugcgccacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugacggccgccgugcuccugcugaucacccacuacgccaucaucggccccggccuccaggcgaaggccacccgggaggcccagaagcgcaccgccgccgggaucaugaagaacccgacggucgacggcaucaugaccaucgaccuggaccccgugaucuacgacuccaaguucgagaagcagcugggccaggugaugcuccugguccugugcgcggugcagcuccugcugaugcggaccagcugggcccucugcgaggcccugacccuggccacgggccccaucaccacccucugggagggcucccccgggaaguucuggaacaccacgaucgcggugagcauggccaacaucuuccgcggcuccuaccuggccggggccggccuggccuucagcaucaugaaguccgucgggaccggcaagcggggcaccgggagccagggcgagacccucggggagaaguggaagaagaagcugaaccagcugagccgcaaggaguucgaccucuacaagaaguccggcaucaccgagguggaccggacggaggcgaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcgcggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccggaccauccgcguccugaagaugguggagccguggcucaagaacaaccaguucugcaucaaggugcugaaccccuacaugcccacggucaucgagcaccuggagcggcuccagcgcaagcacggcgggaugcuggugcggaacccccugucccgcaacagcacccacgagauguacuggaucuccaacggcaccgggaacaucguggccagcgucaacauggugucccggcuccugcugaaccgcuucaccaugacgcaccggcgcccgaccaucgagaaggacguggaccucggcgcgggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgucgugcccauggugacgcagauggcgaugaccgacaccacccccuucgggcagcagcgcgucuucaaggagaagguggacacgcggaccccgcgcagcaugcccggcacccggcgcgugaugggcaucaccgccgaguggcucuggcggacgcuggggcgcaacaagaagccccgccugugcacccgggaggaguucaccaagaagguccgcaccaacgccgccaugggcgcgguguucacggaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcccagcucauccggcagauggagggcgagggggugcugagcaaggccgaccuggagaacccccaccucccggagaagaagaucacccaguggcuggagacgaagggcgucgagcgccugaagcggauggcgaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccgcaucagccagggggcgggcuggucccuccgggagaccgccugccugggcaaggccuacgcccagauguggagccugauguacuuccaccgccgggaccuccgccuggcguccaacgccaucugcagcgccgugcccgugcacugggucccgaccucccggaccacguggagcauccacgcccaccaccaguggaugaccaccgaggacaugcugaccguguggaaccgcguguggaucgaggacaaccccuggauggaggacaagacgcccgucaccaccugggagaacgugcccuaccucgggaagcgggaggaccaguggugcggcagccugaucgggcugaccucccgcgccacgugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 9904 - RNA, 9873 nt, Artificial Sequence
  derived and/or modified CDS sequence (opt1) from DENV-3__GU131877__SS-prME
accagccugugccucaugaugauccugcccgccgcccuggcguuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucguccugaagaaggagguguccgagacccagcacgggaccauccucaucaagguggaguaccggggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcggcucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgucauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccauguucacccugaccgucgccuggcgcacggccacccugauccucgcgggggugagccugcugccggucugccaguccagcuccaugcgcaagaccgacuggcuccccauggccguggccgccaugggcgugccgccccucccgcuguucaucuucagccucaaggacacccugaagcggcgcuccuggccccugaacgagggggucauggccgugggccucgugagcauccuggcguccagccugcuccggaacgacguccccauggccggcccccugguggccgggggccugcucaucgccugcuacgugaucacggggaccuccgccgaccugaccgucgagaaggcggccgacaucaccugggaggaggaggccgagcagacgggcgugagccacaaccugaugaucaccguggacgacgacgggaccaugcgcaucaaggacgacgagaccgagaacauccucaccguccugcugaagacggcccuccugaucaucuccggcguguucccguacagcauccccgccacccugcucguguggcacaccuggcagaagcagacccagcgguccggcguccugugggacgugcccagcccgcccgagacgcagaaggcggagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggcgaucauccgggaggccaucaagcgccggcuccgcacgcugauccuggcccccacccgggucguggccgccgagauggaggaggcgcucaaggggcugcccauccgcuaccagaccaccgccacgaaguccgagcacaccggccgggagaucguggaccugaugugccacgccaccuucaccaugcgccuccugagccccguccgggugccgaacuacaaccugaucaucauggacgaggcccacuucacggaccccgccuccaucgcggcccgcggguacaucagcacccgcgugggcaugggcgaggccgccgcgaucuucaugaccgccacgccgcccgggacggccgacgccuucccgcaguccaacgcccccauccaggacgaggagcgggacauccccgagcgcagcuggaacuccggcaacgaguggaucaccgacuucagcgggaagaccgucugguucgugcccuccaucaaggcgggcaacgacaucgccaacugccuccggaagaacgggaagaaggugauccagcugagccgcaagaccuucgacacggaguaccagaagaccaagcugaacgacugggacuucgucgugaccaccgacaucuccgagaugggcgccaacuucaaggccgaccgggugaucgacccgcgccggugccucaagcccgucauccugacggacggccccgagcgcgugauccuggccgggcccaugccggugaccgcggccagcgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagagccggaagacguucguggagcugaugcgccgcggggaccuccccguguggcuggcgcacaaggucgccuccgagggcaucaaguacaccgaccgcaaguggugcuucgacgggcagcggaacaaccagauccuggaggagaacauggacguggagaucuggaccaaggagggcgagaagaagaagcuccgcccccgcuggcuggacgcccggaccuacagcgacccgcuggcccucaaggaguucaaggacuucgccgcgggccgcaaguccaucgcccuggaccuggucacggagaucgggcgggugcccagccaccucgcccaccgcacccggaacgcccuggacaaccuggugaugcuccacaccagcgagcacggcgggcgcgccuaccggcacgcggucgaggagcugcccgagaccauggagacgcugcuccugcugggccucaugauccugcugaccgggggcgccaugcuguuccugaucuccggcaaggggaucggcaagaccagcaucgggcugaucugcgugaucgccuccagcggcaugcucuggauggccgagaucccgcugcaguggaucgccuccgcgaucgugcuggaguucuucaugaugguccuccugauccccgagcccgagaagcagcgcacgccccaggacaaccagcuggccuacguggugaucgggauccucacgcuggccgccaucaucgccgcgaacgagaugggccugcucgagaccaccaagcgggaccugggcaugagcaaggagccgggggucgugucccccaccagcuaccuggacguggaccuccaccccgccuccgccuggacgcuguacgccgucgcgaccaccgugaucacccccaugcugcgccacacgaucgagaacagcaccgccaacgugucccucgccgccaucgccaaccaggcggucgugcugaugggccuggacaagggguggccgaucagcaagauggaccucggcgugccccugcuggcccucgggugcuacucccaggucaacccccugacccugaccgccgccgugcuccugcugaucacgcacuacgccaucaucggccccggccuccaggcgaaggccacccgggaggcccagaagcgcaccgccgccgggaucaugaagaacccgaccguggacggcaucaugacgaucgaccuggaccccgucaucuacgacagcaaguucgagaagcagcugggccaggugaugcuccuggugcugugcgcgguccagcuccugcugaugcggaccuccugggcccucugcgaggcccugacccuggccaccggccccaucacgacccucugggagggcagccccgggaaguucuggaacaccaccaucgcgguguccauggccaacaucuuccgcggcagcuaccuggccggggccggccuggccuucuccaucaugaaguccguggggacgggcaagcggggcaccgggagccagggcgagacccucggggagaaguggaagaagaagcugaaccagcugucccgcaaggaguucgaccucuacaagaaguccggcaucaccgaggucgaccggaccgaggcgaaggaggggcugaagcgcggcgagaucacgcaccacgccgugucccggggcagcgccaagcugcagugguucguggagcgcaacauggucaucccggaggggcgggugaucgaccucggcugcgggcgcggcgggugguccuacuacugcgccggccugaagaaggugaccgagguccgcggcuacaccaagggcgggcccgggcacgaggagcccgugcccaugagcaccuacggcuggaacaucgugaagcugauguccgggaaggacgucuucuaccucccgcccgagaagugcgacacgcugcugugcgacaucggcgagagcucccccagccccaccguggaggagucccggaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugagccgcaacuccacgcacgagauguacuggaucagcaacggcaccgggaacaucguggccuccgugaacauggucagccggcuccugcugaaccgcuucaccaugacccaccggcgcccgacgaucgagaaggacguggaccucggcgcgggcacccggcacgugaacgccgagcccgagacccccaacauggacgucaucggggagcgcaucaagcggaucaaggaggagcacaacuccaccuggcacuacgacgacgagaacccguacaagacgugggccuaccacggcagcuacgaggugaaggccaccggguccgccagcagcaugaucaacggcguggucaagcugcugaccaagcccugggacgugguccccauggugauccagauggcgaugaccgacacgacccccuucgggcagcagcgcguguucaaggagaaggucgacacccggaccccgcgcuccaugcccggcacgcggcgcgugaugggcaucaccgccgaguggcucuggcggacccuggggcgcaacaagaagccccgccugugcacccgggaggaguucacgaagaaggugcgcaccaacgccgccaugggcgcggucuucaccgaggagaaccagugggacagcgccaaggccgccguggaggacgaggacuucuggaagcucguggaccgggagcgcgagcugcacaagcuggggaagugcggcuccugcgucuacaacaugauggggaagcgggagaagaagcucggcgaguucggcaaggccaaggggagccgcgcgaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgccauguacgccgacgacaccgcggggugggacacgcgcaucaccgaggacgaccugcacaacgaggagaagaucacccagcagauggacccggagcaccggcagcucgccaacgccaucuucaagcugaccuaccagaacaagguggucaaggugcagcgccccacgcccaccggcaccgugauggacaucaucucccggaaggaccagcgcggcagcgggcaggucggcaccuacgggcugaacaccuucacgaacauggaggcccagcucauccggcagauggagggcgagggggugcuguccaaggccgaccuggagaacccccaccucagcgagaagaagaucacccaguggcuggagaccaagggcguggagcgccugaagcggauggcgaucuccggcgacgacugcgucgugaagccgaucgacgaccgcuucgccaacgcccuccuggcccugaacgacauggggaaggugcggaaggacaucccccaguggcagcccagcaagggcuggcacgacuggcagcagguccccuucugcucccaccacuuccacgagcucaucaugaaggacgggcgcaagcugguggugccgugccggccccaggacgagcugaucggccgcgcccgcaucagccagggggcgggcuggucccuccgggagaccgccugccugggcaaggccuacgcccagauguggagccugauguacuuccaccgccgggaccuccgccuggcguccaacgccaucugcagcgccguccccgugcacugggugcccacgagccggaccaccugguccauccacgcccaccaccaguggaugaccacggaggacaugcugaccgucuggaaccgcguguggaucgaggacaacccguggauggaggacaagacccccgugaccacgugggagaacguccccuaccucgggaagcgggaggaccaguggugcggcagccugaucgggcugaccucccgcgccaccugggcgcagaacauccccaccgccauccagcagguccggagccucaucggcaacgaggaguuccuggacuacaugccguccaugaagcgcuuccggaaggaggaggagagcgagggggccaucugguga

SEQ ID NO: 9905 - RNA, 9873 nt, Artificial Sequence
  derived and/or modified CDS sequence (opt1) from DENV-3__GU131878__SS-prME
accagccugugccugaugaugauccugcccgccgcccuggcguuccaccucaccagccgggacggggagccccggaugaucguggggaagaacgagcgcggcaagagccugcuguucaagaccgccagcgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcaccccggguucaccauccucgcgcuguuccuggcccacuacaucggcaccucccucacccagaagguggugaucuucauccugcugaugcucgugacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugcccgaggagcaggaccagaacuacgucugcaagcacaccuacguggaccgcggguggggcaacgggugcggccucuucgggaagggcucccuggugaccugcgccaaguuccagugccuggagcucaucgagggcaaggucgugcaguacgagaaccugaaguacaccgugaucaucacgguccacaccggggaccagcaccaggugggcaacgagacccagggggucaccgccgagaucacgccccaggccagcaccaccgaggcgauccugcccgaguacggcacccucgggcuggagugcagcccccggaccggccuggacuucaacgagaugauccuccugacgaugaagaacaaggccuggauggugcaccgccagugguucuucgaccugccgcuccccuggaccagcggcgccaccaccgagacgcccaccuggaaccggaaggagcugcuggugaccuucaagaacgcccacgccaagaagcaggaggucguggugcucgggucccaggagggcgcgaugcacaccgcccugacgggggccaccgagauccagaacagcggcgggaccuccaucuucgccggccaccugaagugccgccucaagauggacaagcuggagcugaagggcaugagcuacgccaugugcaccaacacguucguccucaagaaggagguguccgagacccagcacgggaccauccugaucaagguggaguacaagggcgaggacgcgcccugcaagaucccguucagcaccgaggacgggcagggcaaggcccacaacggccggcugaucacggccaaccccgucgugaccaagaaggaggagcccgugaacaucgaggccgagcccccguucggggagagcaacaucgucaucggcaccggggacaacgcgcugaagaucaacugguacaagaagggcuccagcaucgggaagauguucgaggccaccgcccgcggcgcccggcgcauggccauccucggcgacacggcgugggacuucggguccgugggcggggugcugaacagccugggcaagaugguccaccagaucuucggguccgccuacaccgcccucuucagcggcguguccugggugaugaagaucggcaucgggguccugcugaccuggaucggccucaacagcaagaacaccuccaugagcuucuccugcaucgccaucgggaucaucacgcuguaccugggcgccguggugcaggcggacauggggugcgucaucaacuggaagggcaaggagcucaagugcggcagcgggaucuucgugaccaacgaggugcacaccuggaccgagcaguacaaguuccaggccgacucccccaagcgccuggccacggccaucgccggcgcgugggagaacggggucugcggcauccggagcaccacccgcauggagaaccugcucuggaagcagaucgccaacgagcugaacuacauccugugggagaacaacaucaagcucaccgugguggucggggacaucaucggcgugcuggagcagggcaagcggacgcugacgccccagcccauggagcucaaguacuccuggaagaccugggggaaggccaagaucgugaccgccgagacgcagaacagcuccuucaucaucgacggcccgaacacccccgagugccccagcgcgucccgcgccuggaacgucugggagguggaggacuacggguucggcguguucaccaccaacaucuggcugaagcugcgggaggucuacacccagcucugcgaccaccgccugaugagcgccgccgugaaggacgagcgggccgugcacgcggacaugggcuacuggaucgagagccagaagaacggguccuggaagcuggagaaggccagccucaucgaggucaagacgugcaccuggcccaagucccacacccuguggagcaacggcgugcuggaguccgacaugaucauccccaagucccucgccgggcccaucucccagcacaaccaccgccccggcuaccacacccagacggccgggccguggcaccugggcaagcuggagcucgacuucaacuacugcgagggcaccaccguggucaucaccgagaacugcgggacgcggggccccagccugcgcaccaccaccguguccgggaagcugauccacgaguggugcugccggagcugcacgcugccgccccuccgcuacaugggcgaggacgggugcugguacggcauggagauccggccgaucuccgagaaggaggagaacauggucaagagccuggucuccgccggcagcgggaagguggacaacuucaccaugggcgugcucugccuggcgauccuguucgaggaggucaugcgcgggaaguucggcaagaagcacaugaucgccgggguguucuucaccuucgugcuccugcuguccggccagaucaccuggcgggacauggcccacacgcucaucaugaucggcagcaacgccuccgaccgcauggggaugggcgucaccuaccuggcccugaucgcgaccuucaagauccagcccuuccucgcccugggguucuuccugcggaagcucaccagccgcgagaaccugcugcucggcgugggccuggccauggccacgacccugcagcuccccgaggacaucgagcagauggcgaacgggaucgcccugggccugauggcccucaagcugaucacccaguucgagaccuaccagcuguggacggcccucaucagccugaccugcuccaacaccauguucacccugacgguggccuggcggaccgcgacccucauccuggccggggucagccugcuccccgugugccaguccagcuccaugcgcaagaccgacuggcugccgauggccgucgccgccaugggcgugccgccccugccccucuucaucuucagccugaaggacacgcugaagcgccgguccuggccgcucaacgagggggugauggcggucggccuggugagcauccuggccuccagccuccugcgcaacgacgugcccauggccggcccccuggucgccgggggccuccugaucgccugcuacgugaucaccgggaccuccgcggaccugaccguggagaaggccgccgacaucacgugggaggaggaggccgagcagaccggcgucagccacaaccucaugaucaccguggacgacgacgggaccaugcggaucaaggacgacgagaccgagaacauccugacggugcugcucaagaccgcccugcugaucgucuccggcguguuccccuacagcaucccggcgacccuccugguguggcacaccuggcagaagcagacgcagcgcuccggcguccugugggacgugcccuccccgcccgagacccagaaggccgagcucgaggaggggguguaccggaucaagcagcagggcaucuucgggaagacccaggucggcgugggggugcagaaggagggcgucuuccacaccauguggcacgugacgcgcggcgccgugcugaccuacaacgggaagcggcuggagccgaacugggccuccgucaagaaggaccucaucagcuacggcgggggcuggcgccuguccgcgcaguggcagaagggggaggagguccaggugaucgccgucgagcccggcaagaaccccaagaacuuccagaccaugcccggcaccuuccagacgaccaccggggagaucggcgccaucgcccuggacuucaagccggggaccagcggcagccccaucaucaaccgggagggcaaggugguggggcuguacggcaacggggucgugacgaagaacggcggguacguguccggcaucgcccagaccaacgcggagcccgacggcccgacccccgagcucgaggaggagauguucaagaagcgcaaccugaccaucauggaccugcaccccgggagcggcaagacgcggaaguaccuccccgccaucguccgcgaggccaucaagcggcgccugcggacccugauccucgccccgacccgcgugguggccgcggagauggaggaggcccugaaggggcugcccauccgguaccagaccacggccaccaaguccgagcacaccggccgcgagaucgucgaccucaugugccacgccaccuucacgaugcggcugcugagccccgugcgcgugcccaacuacaaccucaucaucauggacgaggcccacuucaccgacccggcguccaucgccgcccggggguacaucagcacccgcgucggcaugggcgaggccgcggccaucuucaugaccgccacgccgcccgggaccgccgacgccuucccccaguccaacgcgccgauccaggacgaggagcgcgacauccccgagcggagcuggaacuccggcaacgaguggaucaccgacuucgccgggaagaccgugugguucgugcccagcaucaaggccggcaacgacaucgccaacugccugcgcaagaacgggaagaaggucauccagcugucccggaagacguucgacaccgaguaccagaagaccaagcucaacgacugggacuucguggugaccacggacaucagcgagaugggcgccaacuucaaggcggaccgcgucaucgacccccggcgcugccugaagccggugauccugaccgacggccccgagcgggugauccucgccgggcccaugcccgucaccgccgccuccgccgcgcagcgccggggccgcguggggcggaacccgcagaaggagaacgaccaguacaucuucaccggccagccccugaacaacgacgaggaccacgcccacuggaccgaggccaagaugcugcucgacaacaucaacacgcccgaggggaucauccccgcccuguucgagccggagcgcgagaaguccgcggccaucgacggcgaguaccggcugaagggcgagucccgcaagaccuucguggagcucaugcggcgcggggaccugcccgucuggcuggcccacaagguggccagcgagggcaucaaguacaccgaccggaaguggugcuucgacgggcagcgcaacaaccagauccucgaggagaacauggacgucgagaucuggaccaaggagggcgagaagaagaagcugcggccccgcuggcuggacgcccgcacguacuccgacccccucgcgcugaaggaguucaaggacuucgccgccggccgcaagagcaucgcccuggaccucgugaccgagaucgggcgcgugccgucccaccuggcccaccggacccgcaacgcgcuggacaaccucgucaugcugcacaccagcgagcacggcgggcgggccuaccgccacgccguggaggagcugcccgagacgauggagacccuccugcugcucggccugaugauccugcucaccgggggcgccaugcuguuccugaucagcggcaaggggaucggcaagaccuccaucgggcucaucugcgugaucgccagcuccggcaugcuguggauggcggccaucccccugcaguggaucgccagcgccaucguccucgaguucuucaugauggugcugcugaucccggagcccgagaagcagcggacgccccaggacaaccagcucgccuacguggucaucgggauccugacccuggcggccaucaucgccgccaacgagaugggccuccuggagaccaccaagcgcgaccugggcauguccaaggagcccgggguggugagcccgacguccuaccucgacgucgaccugcaccccgcgagcgccuggacccuguacgccguggccaccaccgugaucacgcccaugcuccggcacaccaucgagaacuccaccgccaacgucagccuggcggccaucgccaaccaggccguggugcugaugggccucgacaagggguggcccaucuccaagauggaccugggcgucccgcugcucgcccuggggugcuacagccaggugaacccccugacccucacggcggccgugcugcugcucaucacccacuacgccaucaucggccccggccugcaggccaaggccacccgcgaggcgcagaagcggaccgccgccgggaucaugaagaaccccacggucgacggcaucaugaccaucgaccuggacccggugaucuacgacuccaaguucgagaagcagcucggccaggugaugcugcugguccucugcgccgugcagcugcugcucaugcgcaccagcugggcgcugugcgaggcccugacccucgccacgggccccaucaccacccugugggagggcucccccgggaaguucuggaacaccacgaucgccgugagcauggccaacaucuuccggggcuccuaccuggcgggggccggccucgccuucagcaucaugaaguccgucgggaccggcaagcgcggcaccgggagccagggcgagacccugggggagaaguggaagaagaagcugaaccagcucagccggaaggaguucgaccuguacaagaaguccggcaucaccgagguggaccgcacggaggccaaggaggggcugaagcggggcgagaucacccaccacgccgugagccgcggcuccgcgaagcuccagugguucgucgagcggaacauggugauccccgaggggcgcgugaucgaccugggcugcgggcggggcggguggagcuacuacugcgccggccugaagaaggucaccgaggugcgcggcuacaccaagggcgggccggggcacgaggagcccgugcccauguccacguacggcuggaacaucgucaagcucaugagcgggaaggacguguucuaccugcccccggagaagugcgacacccugcugugcgacaucggcgaguccagccccucccccaccguggaggagagccgcaccauccggguccucaagaugguggagcccuggcugaagaacaaccaguucugcaucaaggugcugaacccguacaugcccacggucaucgagcaccucgagcgccugcagcggaagcacggcgggaugcuggugcgcaacccccucucccggaacagcacccacgagauguacuggaucuccaacggcaccgggaacaucguggccagcgucaacauggugucccgccugcugcucaaccgguucaccaugacgcaccgccggcccaccaucgagaaggacguggaccugggcgccggcacccgccacgucaacgccgagccggagacccccaacauggacgugaucggggagcggaucaagcgcaucaaggaggagcacaacagcacguggcacuacgacgacgagaaccccuacaagaccugggcguaccacggcuccuacgaggugaaggccaccgggagcgccuccagcaugaucaacggcgucgugaagcugcucaccaagccgugggacgucgugcccauggugacgcagauggccaugaccgacaccacccccuucgggcagcagcgggucuucaaggagaagguggacacgcgcacgccccggagcaugccgggcacccgccgggugaugggcaucaccgcggaguggcuguggcgcacccuggggcggaacaagaagccccgccucugcacccgcgaggaguucaccaagaagguccggaccaacgccgccaugggcgccguguucacggaggagaaccagugggacuccgccaaggcggccguggaggacgaggacuucuggaagcuggucgaccgcgagcgggagcugcacaagcucgggaagugcggcagcugcguguacaacaugauggggaagcgcgagaagaagcugggcgaguucggcaaggccaaggggucccgggccaucugguacauguggcugggcgcccgcuaccucgaguucgaggcgcugggguuccugaacgaggaccacugguucagccgggagaacuccuacagcggcguggagggggagggccuccacaagcugggcuacauccugcgcgacaucuccaagauccccgggggcgccauguacgccgacgacaccgccgggugggacacccggaucaccgaggacgaccuccacaacgaggagaagaucacgcagcagauggaccccgagcaccgccagcuggccaacgcgaucuucaagcugaccuaccagaacaaggucgugaaggugcagcggccgacccccaccggcaccgucauggacaucaucagccgcaaggaccagcggggcuccggccaggugggcacguacgggcucaacaccuucaccaacauggaggcccagcugauccgccagauggagggcgagggggugcugagcaaggccgaccucgagaacccccaccuccccgagaagaagaucacccaguggcuggagacgaagggcgucgagcggcucaagcgcauggccaucuccggcgacgacugcguggugaagccgaucgacgaccgguucgccaacgcgcugcuggcccucaacgacauggggaagguccgcaaggacaucccccaguggcagcccagcaagggcuggcacgacuggcagcagguccccuucugcucccaccacuuccacgagcugaucaugaaggacgggcggaagcugguggucccgugccgcccccaggacgagcucaucggccgggcccgcaucagccagggggccggcuggucccugcgcgagaccgcgugccugggcaaggccuacgcccagauguggagccucauguacuuccaccggcgcgaccugcggcuggccuccaacgccaucugcagcgcggugcccgugcacuggguccccaccucccgcaccacguggagcauccacgcccaccaccaguggaugaccaccgaggacaugcucaccguguggaaccggguguggaucgaggacaacccguggauggaggacaagacgcccgucaccaccugggagaacgugcccuaccuggggaagcgcgaggaccaguggugcggcagccugaucgggcucaccucccgggccacgugggcccagaacauccccaccgccauccagcagguccgcagccugaucggcaacgaggaguuccuggacuacaugccguccaugaagcgguuccgcaaggaggaggagagcgagggggcgaucugguga

SEQ ID NO: 9906 - RNA, 9873 nt, Artificial Sequence
  derived and/or modified CDS sequence (opt1) from DENV-3__FJ898455__SS-prME
accagccugugccucaugaugaugcugcccgccacccuggccuuccaccucaccagccgcgacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcggagcguggcccuggcgccccacgugggcauggggcuggacacccgcacccagaccuggaugagcgcggagggcgccuggcggcaggucgagaaggucgagaccugggccuuccgccaccccggguucaccauccucgcccuguuccuggcgcacuacaucggcaccucccucacccagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagaucccguucagcaccgaggacgggcagggcaaggcccacaacggccggcugaucaccgccaaccccaucgucacgaagaaggaggagcccgugaacaucgaggcggagcccccguucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucgucgugggggacgugaucggcguccuggagcagggcaagcggacccugacgccccagcccauggagcucaaguacagcuggaagacgugggggaaggccaagaucgugaccgccgagacccagaacuccagcuucaucaucgacggcccgaacacccccgagugccccuccgcgagccgcgccuggaacgugugggaggucgaggacuacggguucggcguguucacgaccaacaucuggcugaagcugcgggagauguacacccagcucugcgaccaccgccugaugagcgccgccgugaaggacgagcgggccguccacgcggacaugggcuacuggaucgagucccagaagaacgggagcuggaagcuggagaaggccucccucaucgaggugaagaccugcaccuggcccaagagccacacgcugugguccaacggcgugcuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacggucgugaucaccgagaacugcgggacccggggccccucccugcgcaccacgaccgugagcgggaagcugauccacgaguggugcugccgguccugcacccugccgccccuccgcuacaugggcgaggacgggugcugguacggcauggagauccggccgaucaacgagaaggaggagaacauggucaagagccugguguccgccggcagcgggaaggcggacaacuucaccaugggcgugcucugccuggccauccuguucgaggaggucaugcgcgggaaguucggcaagaagcacaugaucgccggggcccucuucacguucgugcugcugcucuccggccagaucaccuggcgggacauggcccacacccugaucaugaucggcagcaacgcguccgaccgcauggggaugggcgugaccuaccuggcccucaucgccacguucaagauccagcccuuccuggcccugggguucuuccuccggaagcugaccagccgcgagaaccugcuccugggcgucggccuggcgauggccaccacccuccagcugcccgaggacaucgagcagauggccaacgggaucgcccugggccucauggcccugaagcugaucacgcaguucgagaccuaccagcucuggaccgcgcuggugagccugaugugcuccaacaccaucuucacgcucaccguggccuggcggaccgccacccugauccuggccgucaucagccuccugcccgugugccaguccagcuccaugcgcaagacggacuggcugccgaugaccguggccgcgaugggggugccgccccucccccuguucaucuucagccugaaggacacccucaagcggcgcuccuggccgcugaacgagggcgugauggccgucgggcuggugagcauccucgccuccagcuuccugcgcaacgacgugcccauggccggcccccuggucgccggcgggcuccugaucgcgugcuacgugaucaccggcacguccgccgaccugaccguggagaaggccgccgacgucaccugggaggaggaggccgagcagaccggggugagccacaaccucaugaucacgguggacgacgacggcaccaugcggaucaaggacgacgagaccgagaacauccugaccguccugcucaagaccgcgcugcugaucguguccgggaucuuccccuacagcaucccggccacgcuccugguguggcacaccuggcagaagcagacccagcgcuccggcguccugugggacgugcccuccccgcccgagacccagaaggccgagcucgaggagggcguguaccggaucaagcagcaggggaucuucggcaagacgcaggucggggugggcgugcacaaggagggggucuuccacaccauguggcacgugacccgcggcgccgugcugacccacaacggcaagcggcuggagccgaacugggcgaacgucaagaaggaccucaucuccuacgggggcggguggaagcugagcgcccaguggcagaagggcgaggagguccaggugaucgccgucgagcccgggaagaaccccaagaacuuccagacgaugcccggcaucuuccagaccaccaccggcgagaucggggccaucgcccuggacuucaagccgggcacguccgggagccccaucaucaaccgcgagggcaagguggugggccuguacgggaacggcgucgugaccaagaacgggggcuacgugagcgggaucgcgcagaccaacgccgagcccgacggcccgacccccgagcucgaggaggagauguucaagaagcggaaccugacgaucauggaccugcaccccggcuccgggaagacccgcaaguaccuccccgccaucguccgggaggccaucaagcgccggcugcgcacccugauccucgccccgacccgggugguggcggccgagauggaggaggcccugaagggccugcccauccgcuaccagacgaccgccaccaagagcgagcacaccgggcgggagaucgucgaccucaugugccacgccacguucaccaugcgccugcugucccccgugcgggugcccaacuacaaccucaucgucauggacgaggcgcacuucaccgacccggccagcaucgccgcccgcggcuacaucuccacccggguggggaugggcgaggcggccgccaucuucaugacggccacgccgcccggcaccgccgacgcguucccccagagcaacgccccgauccaggacgaggagcgcgacauccccgagcgguccuggaacagcgggaacgaguggaucaccgacuucgccggcaagacggugugguucguccccuccaucaaggccgggaacgacaucgccaacugccugcgcaagaacggcaagaaggugauccagcugagccgcaagaccuucgacaccgaguaccagaagaccaagcucaacgacugggacuucguggucacgaccgacaucuccgagaugggggcgaacuucaaggccgaccgggugaucgacccccgccggugccugaagccggugauccugaccgacggccccgagcgcgucauccucgccggccccaugcccgugaccguggccagcgccgcgcagcggcgcgggcgggucggccgcaacccgcagaaggagaacgaccaguacaucuucacggggcagccccugaacaacgacgaggaccacgcccacuggaccgaggccaagaugcugcucgacaacaucaacacccccgagggcaucauccccgcccuguucgagccggagcgggagaaguccgcggccaucgacggggaguaccgccugaagggcgagagccggaagaccuucguggagcucaugcgccggggcgaccugcccguguggcuggcccacaaggucgccuccgaggggaucaaguacaccgaccgcaaguggugcuucgacggcgagcggaacaaccagauccucgaggagaacauggacguggagaucuggacgaaggagggggagcgcaagaagcugcggccccgcuggcuggacgcccggaccuacagcgacccccucgcgcugaaggaguucaaggacuucgccgccggccgcaaguccaucgcccuggaccucgucaccgagaucggccgcgugccgagccaccuggcccaccggacccgcaacgcgcuggacaaccucgugaugcugcacacguccgagcacgggggccgggccuaccgccacgccgucgaggagcugcccgagaccauggagacccuccugcugcucgggcugaugauccugcucaccggcggggccaugcuguuccugaucagcggcaagggcaucgggaagacgagcaucggccucaucugcgugguggccuccagcgggaugcuguggauggcggacgucccccugcaguggaucgccuccgccaucgugcucgaguucuucaugauggugcugcugaucccggagcccgagaagcagcggacgccccaggacaaccagcucgccuacgucgugaucggcauccugacccuggccgcgaucguggccgccaacgagauggggcuccuggagaccacgaagcgcgaccugggcaugagcaaggagcccggcgucguguccccgaccagcuaccucgacguggaccugcaccccgccuccgcguggacccuguacgccgucgccaccacggugaucacccccaugcuccggcacaccaucgagaacagcaccgccaacgugucccuggccgcgaucgccaaccaggccgucgugcugauggggcucgacaagggcuggcccaucagcaagauggaccugggggugccgcugcucgcccugggcugcuacucccaggucaacccccugacgcucaccgccgcggugcugcugcucgugacccacuacgccaucaucgggcccggccugcaggccaaggccacccgcgaggcccagaagcggacggcggccggcaucaugaagaaccccaccgucgacgggaucaugaccaucgaccuggacccggugaucuacgacagcaaguucgagaagcagcucggccaggugaugcugcugguccucugcgccgugcagcugcugcucaugcgcaccuccugggccuucugcgaggcgcugacgcuggccaccgggcccaucaccacccucugggagggcagccccggcaaguucuggaacacgaccaucgccguguccauggccaacaucuuccgggggagcuaccuggccggcgcggggcuggccuucuccaucaugaaguccgucggcaccgggaagcgcggcaccggcucccagggggagacgcucggcgagaaguggaagaagaagcugaaccagcugagccggaaggaguucgaccucuacaagaaguccgggaucaccgagguggaccgcaccgaggccaaggagggccugaagcgcggggagaucacccaccacgccgugucccgcggcagcgccaagcugcagugguucgucgagcggaacauggugauccccgagggccgcgugaucgaccucgggugcggccgcgggggcugguccuacuacugcgcggggcugaagaaggucaccgaggugcgcggcuacacgaagggcgggccgggccacgaggagcccgugcccaugagcaccuacggguggaacaucgucaagcugauguccggcaaggacguguucuaccucccgcccgagaagugcgacacccugcugugcgacaucggggagagcucccccagccccaccguggaggagucccggacgauccgcguccugaagaugguggagcccuggcucaagaacaaccaguucugcaucaaggugcugaaccccuacaugcccaccgucaucgagcaccuggagcgccuccagcggaagcacggcggcaugcuggugcgcaacccccugagccggaacuccacccacgagauguacuggaucagcaacgggaccggcaacaucguguccagcgucaacauggugucccgccuccugcugaaccgguucacgaugacccaccgccggcccaccaucgagaaggacguggaccucggggccggcacccgccacgucaacgccgagccggagacgcccaacauggacgugaucggcgagcggauccgccggaucaaggaggagcacagcuccaccuggcacuacgacgacgagaaccccuacaagaccugggccuaccacgggagcuacgaggucaaggccaccggcuccgcgagcagcaugaucaacgggguggugaagcugcugacgaagccgugggacgucgugcccauggugacccagauggccaugaccgacaccacgcccuucggccagcagcgcgucuucaaggagaagguggacacccggacgccccggccgaugcccgggacccggaaggugauggagaucacggccgaguggcucuggcgcacccugggccggaacaagcgcccccggcugugcacccgcgaggaguucaucaagaagguccgcaccaacgccgcgaugggcgccguguucacggaggagaaccagugggacuccgcccgggccgccguggaggacgaggaguucuggaagcucgucgaccgcgagcgggagcugcacaagcuggggaagugcggcagcugcguguacaacaugauggggaagcgcgagaagaagcucggcgaguucgggaaggcgaagggcucccgggccaucugguacauguggcugggcgcccgcuaccuggaguucgaggcccucggguuccugaacgaggaccacugguucagccgggagaacuccuacagcggcguggagggggagggccugcacaagcucggguacauccugcgcgacaucuccaagauccccggcggcgccauguacgcggacgacaccgccgggugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaagggcaccgucauggacaucaucagccgcaaggaccagcggggguccggccaggugggcacguacgggcugaacaccuucaccaacauggaggcccagcucauccgccagauggagggcgagggggugcugagcaaggcggaccuggagaacccccaccuccuggagaagaaggucacccaguggcuggagaccaagggcguggagcggcucaagcgcauggccaucuccggggacgacugcguggucaagccgaucgacgaccgguucgccaacgcccugcuggcccucaacgacaugggcaaggugcgcaaggacaucccccaguggcagcccagcaagggcuggcacgacuggcagcagguccccuucugcucccaccacuuccacgagcugaucaugaaggacgggcggaagcuggucgugccgugccgcccccaggacgagcucaucggccgggcgcgcaucagccagggggccggcuggucccugcgcgagacggccugccuggggaaggccuacgcgcagaugugggcccucauguacuuccaccggcgcgaccugcggcuggccagcaacgccaucugcuccgccgugcccguccacugggugcccaccagccgcaccaccugguccauccacgcgcaccaccaguggaugacgaccgaggacaugcucaccguguggaaccgggucuggaucgaggacaacccguggauggaggacaagacccccgugacgaccugggaggacgugcccuaccugggcaagcgcgaggaccaguggugcggcagccugaucgggcucaccagccgggccaccugggcccagaacauccugacggccauccagcagguccgcucccugaucggcaacgaggaguuccucgacuacaugcccagcaugaagcgguuccgcaaggaggaggaguccgagggggccaucugguga

SEQ ID NO: 9907 - RNA, 9873 nt, Artificial Sequence
  derived and/or modified CDS sequence (opt1) from DENV-3__GQ199891__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaaggccgugaucuucauccugcugaugcucgugacgcccagcaugaccaugcggugcgugggggugggcaaccgcgacuucguggagggccuguccggggccaccugggucgacguggugcuggagcacggcgggugcgucaccacgauggccaagaacaagcccacccucgacaucgagcugcagaagaccgaggcgacccagcuggccacgcuccggaagcugugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgcgaagaagcaggagguggucgugcuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcggggagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccguggccuggcgcacggcgacccugauccucgccggggucagccugcugccggugugccaguccagcuccaugcggaagaccgacuggcuccccaugaccgucgccgccaugggcgugccgccccucccgcuguucaucuucagccucaaggacacgcugaagcgccgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugaccguggagaaggcggccgacgucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagacgaccaccggggagaucggcgccaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggcgaucguccgggaggccaucaagcgccggcuccgcacccugauccuggcccccacccgggugguggccgccgagauggaggaggcgcucaaggggcugcccauccgcuaccagaccacggccaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgcggcccgcggguacaucagcacccgggucggcaugggcgaggccgccgcgaucuucaugaccgccacgccgcccgggaccgccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacgcccgaggggaucaucccggcccucuucgagcccgagcgggagaaguccgccgcgaucgacggcgaguaccgccugaagggcgagucccggaagaccuucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggacuucgcggccggccgcaagagcaucgcccuggaccuggugaccgagaucgggcgggugcccacccaccucgcccaccgcacccggaacgcccuggacaaccuggucaugcuccacacguccgagcacggcgggaaggcguaccgccacgccguggaggagcugcccgagaccauggagacccugcuccugcugggccucaugauccugcugaccgggggcgccaugcuguuccugaucagcggcaaggggaucggcaagacgagcaucgggcugaucugcgugaucgccuccagcggcaugcucuggauggccgagaucccgcugcaguggaucgcguccgccaucguccuggaguucuucaugauggugcuccugauccccgagcccgagaagcagcggacgccccaggacaaccagcuggccuacguggucaucgggauccucacccuggccgccaucaucgcggccaacgagaugggccugcucgagaccacgaagcgcgaccugggcaugagcaaggagccggggguggugucccccaccagcuaccuggacgucgaccuccaccccgccuccgccuggacccuguacgcgguggccaccacggugaucacccccaugcugcggcacaccaucgagaacagcaccgccaacgucucccucgccgccaucgcgaaccaggccguggugcugaugggccuggacaagggguggccgaucagcaagauggaccucggcgucccccugcuggcccucgggugcuacucccaggugaacccccugacgcugaccgccgccgugcuccugcugaucacccacuacgcgaucaucggccccggccuccaggccaaggccacccgcgaggcccagaagcggacggccgcggggaucaugaagaacccgaccgucgacggcaucaugaccaucgaccuggaccccgugaucuacgacagcaaguucgagaagcagcugggccaggugaugcuccugguccugugcgccgugcagcuccugcugaugcgcaccuccugggcccucugcgaggcccugacgcuggcgaccggccccaucaccacccucugggagggcagccccgggaaguucuggaacacgaccaucgccguguccauggccaacaucuuccggggcagcuaccuggccggggccggccuggcguucuccaucaugaaguccgucgggaccggcaagcgcggcaccgggucccagggcgagacccucggggagaaguggaagaagaagcugaaccagcugagccggaaggaguucgaccucuacaagaaguccggcaucacggagguggaccgcaccgaggccaaggaggggcugaagcggggcgagaucacccaccacgccgugucccgcggcagcgccaagcugcagugguucgucgagcggaacauggugaucccggaggggcgcgugaucgaccucggcugcgggcggggcgggugguccuacuacugcgccggccugaagaaggucaccgaggugcgcggcuacacgaagggcgggcccgggcacgaggagcccgugcccaugagcaccuacggcuggaacaucgucaagcugauguccgggaaggacguguucuaccucccgcccgagaagugcgacacccugcugugcgacaucggcgagagcucccccagccccaccguggaggagucccggacgauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugagccggaacuccacccacgagauguacuggaucagcaacggcaccgggaacaucguggcguccgucaacauggugagccgccuccugcugaaccgguucacgaugacccaccgccggccgaccaucgagaaggacguggaccucggcgccggcacccgccacgucaacgccgagcccgagacgcccaacauggacgugaucggggagcggaucaagcgcaucaaggaggagcacaacuccaccuggcacuacgacgacgagaacccguacaagaccugggccuaccacggcagcuacgaggugaaggccaccggguccgcgagcuccaugaucaacggcgucgugaagcugcugacgaagcccugggacgucgugcccauggugacccagauggccaugaccgacaccacgcccuucgggcagcagcgggucuucaaggagaagguggacacccgcaccccgcggagcaugcccggcacccgccgggugaugggcaucacggccgaguggcucuggcgcacccuggggcggaacaagaagccccgccugugcacccgggaggaguucaccaagaagguccgcacgaacgccgcgaugggcgccguguucaccgaggagaaccagugggacagcgccaaggccgccguggaggacgaggacuucuggaagcucgucgaccgcgagcgggagcugcacaagcuggggaagugcggcuccugcguguacaacaugauggggaagcgcgagaagaagcucggcgaguucggcaaggcgaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgcggacgacaccgccgggugggacacccggaucacggaggacgaccugcacaacgaggagaagaucacccagcagauggacccggagcaccgccagcucgccaacgccaucuucaagcugaccuaccagaacaaggucgugaaggugcagcggcccacccccaccggcacggucauggacaucaucucccgcaaggaccagcggggcagcggccaggugggcaccuacgggcugaacaccuucaccaacauggaggcccagcucauccgccagauggagggcgagggggugcuguccaaggcggaccuggagaacccccaccucccggagaagaagaucacgcaguggcuggagaccaagggcgucgagcggcugaagcgcauggccaucagcggcgacgacugcguggugaagcccaucgacgaccgguucgccaacgcccuccuggcccugaacgacauggggaagguccgcaaggacaucccccaguggcagcccuccaagggcuggcacgacuggcagcaggucccguucugcagccaccacuuccacgagcucaucaugaaggacgggcggaagcuggugguccccugccgcccccaggacgagcugaucggccgggcgcgcaucucccagggggccggcuggagccuccgggagaccgccugccugggcaaggccuacgcgcagauguggucccugauguacuuccaccgccgcgaccuccggcuggccagcaacgccaucugcuccgccgugcccgugcacugggucccgaccagccgcacgaccugguccauccacgcccaccaccaguggaugaccaccgaggacaugcugacgguguggaaccggguguggaucgaggacaaccccuggauggaggacaagacccccgucaccaccugggagaacgugcccuaccucgggaagcgcgaggaccaguggugcggcagccugaucgggcugacgagccgggcgaccugggcccagaacaucccgaccgccauccagcagguccgcucccucaucggcaacgaggaguuccuggacuacaugcccagcaugaagcgguuccgcaaggaggaggaguccgagggggccaucugguga

SEQ ID NO: 9908 - RNA, 9873 nt, Artificial Sequence
  derived and/or modified CDS sequence (opt1) from DENV-3__FJ898443__SS-prME
accagccucugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaaggccgugaucuucauccugcugaugcucgugacgcccagcaugaccaugcggugcgugggggugggcaaccgcgacuucguggagggccuguccggggccaccugggucgacguggugcuggagcacggcgggugcgucaccacgauggccaagaacaagcccacccucgacaucgagcugcagaagaccgaggcgacccagcuggccacgcuccggaagcugugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgcgaagaagcaggagguggucgugcuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaccggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccguggucaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccuggucuccgccggcagcgggaagguggacaacuucaccaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacgcugaucaugaucggcagcaacgccuccgaccggauggggaugggcgucaccuaccucgcccugaucgcgaccuucaagauccagcccuuccuggcccucggguucuuccugcgcaagcugaccagccgggagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccaucuucacccugacgguggccuggcgcaccgcgacccugauccucgccggggucagccugcugccggugugccaguccagcuccaugcggaagaccgacuggcuccccaugacggucgccgccaugggcgugccgccccucccgcuguucaucuucagccucaaggacacccugaagcgccgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugacgguggagaaggcggccgacgucaccugggaggaggaggccgagcagaccggcgugagccacaaccugaugaucaccguggacgacgacgggaccaugcgcaucaaggacgacgagacggagaacauccucaccguccugcugaagaccgcccuccugaucguguccggcaucuucccguacagcauccccgccacccugcucguguggcacacguggcagaagcagacccagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacacgauguggcacgugacccggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcacguuccagaccaccaccggggagaucggcgccaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucguccgggaggccaucaagcgccggcuccgcacccugauccuggcccccacccgggugguggccgccgagauggaggaggcgcucaaggggcugcccauccgcuaccagacgaccgccaccaaguccgagcacaccggccgggagaucgucgaccugaugugccacgccacguucaccaugcgccuccugagccccgugcgggugccgaacuacaaccugaucaucauggacgaggcccacuucaccgaccccgccuccaucgcggcccgcggguacaucagcacccgggucggcaugggcgaggccgccgcgaucuucaugacggccacgccgcccgggaccgccgacgccuucccgcaguccaacgcccccauccaggacgaggagcgcgacauccccgagcgcagcuggaacuccggcaacgaguggaucaccgacuucgcggggaagacggugugguucgugcccagcaucaaggccggcaacgacaucgccaacugccuccggaagaacgggaagaaggucauccagcugucccgcaagaccuucgacaccgaguaccagaagaccaagcugaacgacugggacuucguggugacgaccgacaucagcgagaugggcgccaacuucaaggccgaccgggucaucgacccgcgccggugccucaagcccgugauccugaccgacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgggagaaguccgccgcgaucgacggcgaguaccgccugaagggcgagucccggaagaccuucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggacgaaggagggcgagaagaagaagcuccgcccccgguggcuggacgcccgcaccuacuccgacccgcuggcccucaaggaguucaaggacuucgcggccggccgcaagagcaucgcccuggaccuggugaccgagaucgggcgggugcccacccaccucgcccaccgcacgcggaacgcccuggacaaccuggucaugcuccacaccuccgagcacggcgggaaggcguaccgccacgccguggaggagcugcccgagaccauggagacccugcuccugcugggccucaugauccugcugaccggcggggccaugcuguuccugaucagcgggaaggggaucggcaagaccagcaucgggcugaucugcgugaucgccuccagcggcaugcucuggauggccgagaucccgcugcaguggaucgcguccgccaucguccuggaguucuucaugauggugcuccugauccccgagcccgagaagcagcggacgccccaggacaaccagcuggccuacguggucaucgggauccucacccuggccgccaucaucgcggccaacgagaugggccugcucgagacgaccaagcgcgaccugggcaugagcaaggagccggggguggugucccccaccagcuaccuggacgucgaccuccaccccgccuccgccuggacccuguacgcgguggccacgaccgugaucacccccaugcugcggcacaccaucgagaacagcacggccaacgucucccucgccgccaucgcgaaccaggccguggugcugaugggccuggacaagggguggccgaucagcaagauggaccucggcgucccccugcuggcccucgggugcuacucccaggugaacccccugacccugaccgccgccgugcuccugcugaucacccacuacgcgaucaucggccccggccuccaggccaaggccacgcgcgaggcccagaagcggaccgccgcggggaucaugaagaacccgaccgucgacggcaucaugaccaucgaccuggaccccgugaucuacgacagcaaguucgagaagcagcugggccaggugaugcuccugguccugugcgccgugcagcuccugcugaugcgcacguccugggcccucugcgaggcccugacccuggcgaccggccccaucaccacgcucugggagggcagccccgggaaguucuggaacaccaccaucgccguguccauggccaacaucuuccggggcagcuaccuggccggggccggccuggcguucuccaucaugaaguccgucgggaccggcaagcgcggcaccgggucccagggcgagacgcucggggagaaguggaagaugaagcugaaccagcugagccggaaggaguucgaccucuacaagaaguccggcaucaccgagguggaccgcaccgaggccaaggaggggcugaagcggggcgagaucacccaccacgccgugucccgcggcagcgccaagcugcagugguucgucgagcggaacauggugaucccggaggggcgcgugaucgaccucggcugcgggcggggcgggugguccuacuacugcgccggccugaagaaggucacggaggugcgcggcuacaccaagggcgggcccgggcacgaggagcccgugcccaugagcaccuacggcuggaacaucgucaagcugauguccgggaaggacguguucuaccucccgcccgagaagugcgacacccugcugugcgacaucggcgagagcucccccagccccacgguggaggagucccggaccauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugagccggaacuccacccacgagauguacuggaucagcaacggcacggggaacaucguggcguccgucaacauggugagccgccuccugcugaaccgguucaccaugacccaccgccggccgaccaucgagaaggacguggaccucggcgccggcacgcgccacgucaacgccgagcccgagacccccaacauggacgugaucggggagcggaucaagcgcaucaaggaggagcacaacuccaccuggcacuacgacgacgagaacccguacaagaccugggccuaccacggcagcuacgaggugaaggccacgggguccgcgagcuccaugaucaacggcgucgugaagcugcugaccaagcccugggacgucgugcccauggugacccagauggccaugaccgacacgacccccuucgggcagcagcgggucuucaaggagaagguggacacccgcaccccgcggagcaugcccggcacgcgccgggugaugggcaucaccgccgaguggcucuggcgcacccuggggcggaacaagaagccccgccugugcacccgggaggaguucacgaagaagguccgcaccaacgccgcgaugggcgccguguucaccgaggagaaccagugggacagcgccaaggccgccguggaggacgaggacuucuggaagcucgucgaccgcgagcgggagcugcacaagcuggggaagugcggcuccugcguguacaacaugauggggaagcgcgagaagaagcucggcgaguucggcaaggcgaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgcggacgacaccgccgggugggacacgcggaucaccgaggacgaccugcacaacgaggagaagaucacccagcagauggacccggagcaccgccagcucgccaacgccaucuucaagcugaccuaccagaacaaggucgugaaggugcagcggcccacccccacgggcaccgucauggacaucaucucccgcaaggaccagcggggcagcggccaggugggcaccuacgggcugaacaccuucacgaacauggaggcccagcucauccgccagauggagggcgagggggugcuguccaaggcggaccuggagaacccccaccucccggagaagaagaucacccaguggcuggagaccaagggcgucgagcggcugaagcgcauggccaucagcggcgacgacugcguggugaagcccaucgacgaccgguucgccaacgcccuccuggcccugaacgacauggggaagguccgcaaggacaucccccaguggcagcccuccaagggcuggcacgacuggcagcaggucccguucugcagccaccacuuccacgagcucaucaugaaggacgggcggaagcuggugguccccugccgcccccaggacgagcugaucggccgggcgcgcaucucccagggggccggcuggagccuccgggagaccgccugccugggcaaggccuacgcgcagauguggucccugauguacuuccaccgccgcgaccuccggcuggccagcaacgccaucugcuccgccgugcccgugcacugggucccgacgagccgcaccaccugguccauccacgcccaccaccaguggaugaccacggaggacaugcugaccguguggaaccggguguggaucgaggacaaccccuggauggaggacaagacccccgucaccacgugggagaacgugcccuaccucgggaagcgcgaggaccaguggugcggcagccugaucgggcugaccagccgggcgaccugggcccagaacaucccgaccgccauccagcagguccgcucccucaucggcaacgaggaguuccuggacuacaugcccagcaugaagcgguuccgcaaggaggaggagcuggagggggccaucugguga

SEQ ID NO: 9909 - RNA, 9873 nt, Artificial Sequence
  derived and/or modified CDS sequence (opt1) from DENV-3__FJ898444__SS-prME
accagccugugccucaugaugauccugcccgccgcccuggcguuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgggacaagcggagcguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgagcaggggaaggcccacaacggccgccugaucacggccaaccccgucgugaccaagaaggaggagcccgugaacaucgaggccgagccgcccuucggcgagagcaacaucgucaucgggaucggcgacaacgcgcugaagaucaacugguacaagaagggguccagcaucggcaagauguucgaggccaccgcccgcggggcccgccggauggccauccugggcgacaccgcgugggacuucggcuccgucgggggcgugcucaacagccuggggaagaugguccaccagaucuucggcuccgccuacacggcccuguucagcgggguguccugggugaugaagaucggcaucggcguccuccugaccuggaucgggcugaacagcaagaacaccuccaugagcuucuccugcaucgccaucggcaucaucacccucuaccugggggccguggugcaggcggacaugggcugcgucgugaacuggaaggggaaggagcugaagugcggcagcggcaucuucgugacgaacgagguccacaccuggaccgagcaguacaaguuccaggccgacucccccaagcgccucgccaccgccaucgccggggcgugggagaacggcgugugcgggauccgcagcacgacccggauggagaaccugcuguggaagcagaucgccaacgagcucaacuacauccugugggagaacaacaucaagcugaccguggucgugggcgacaucaucggggugcucgagcagggcaagcgcacccugacgccccagccgauggagcugaaguacuccuggaagaccuggggcaaggccaagaucgucaccgccgagacccagaacagcuccuucaucaucgacgggcccaacacgcccgagugccccagcgcgucccgggccuggaacgugugggagguggaggacuacggcuucggggucuucaccaccaacaucuggcucaagcugcgcgagguguacacccagcugugcgaccaccggcucaugagcgccgccgugaaggacgagcgcgccguccacgcggacaugggcuacuggaucgagagccagaagaacggcuccuggaagcuggagaaggccagccugaucgaggugaagaccugcacguggccgaagucccacacccucuggagcaacggggugcuggaguccgacaugaucauccccaagagccuggccggccccaucucccagcacaacuaccggccgggguaccacacccagaccgccggccccuggcaccucgggaagcuggagcuggacuucaacuacugcgagggcacgaccgucgugaucaccgagaacugcggcacccgcgggcccagccuccggacgaccaccguguccggcaagcugauccacgaguggugcugccgcagcugcacccugcccccgcuccgguacaugggggaggacggcugcugguacgggauggagauccgccccaucuccgagaaggaggagaacauggucaagagccugguguccgccggcagcggcgagguggacaacuucacgauggggguccugugccucgcgauccuguucgaggaggugaugcggggcaaguucgggaagaagcacaugaucgccggcguguucuucaccuucguccugcuccuguccgggcagaucaccuggcgcgacauggcccacacccugaucaugaucggcagcaacgccuccgaccggaugggcaugggggugacguaccucgcccugaucgcgaccuucaagauccagcccuuccuggcccucggcuucuuccugcgcaagcugaccagccgggagaaccuccugcugggggugggccucgccauggccaccacgcugcagcugcccgaggacaucgagcagauggcgaacggcaucgcccucgggcugauggcccugaagcucaucacccaguucgagaccuaccagcuguggaccgcccugaucagccucacgugcuccaacaccaucuucacccugaccgucgccuggcgcacggcgacccugauccucgccggcgugagccugcugccggucugccaguccagcuccaugcggaagaccgacuggcuccccaugaccguggccgccaugggggugccgccccucccgcuguucaucuucagccucaaggacacgcugaagcgccgcuccuggccccugaacgagggcgucauggccguggggcucgugagcauccuggcguccagccugcuccggaacgacguccccauggccggcccccugguggccggcgggcugcucaucgccugcuacgugaucaccggcaccuccgccgaccugaccgucgagaaggcggccgacgugacgugggaggaggaggccgagcagaccggggugagccacaaccugaugaucaccgucgacgacgacggcaccaugcgcaucaaggacgacgagaccgagaacauccucacggugcugcugaagaccgcccuccugaucguguccgggaucuucccguacagcauccccgccacccugcucgucuggcacaccuggcagaagcagacgcagcgguccggcgugcugugggacgugcccagcccgcccgagacccagaaggcggagcuggaggagggcgucuaccgcaucaagcagcaggggaucuucggcaagacccaggugggggugggcguccagaaggaggggguguuccacaccauguggcacgugacgcggggcgccguccucaccuacaacggcaagcgccuggagcccaacugggccuccgugaagaaggaccugaucagcuacgggggcggguggcggcucuccgcccaguggcagaagggcgaggaggugcaggucaucgcgguggagcccgggaagaaccccaagaacuuccagaccaugcccggcaccuuccagacgaccaccggcgagaucggggccaucgcccuggacuucaagcccggcaccagcgggagccccaucaucaaccgcgagggcaagguggucggccuguacgggaacggcguggugacgaagaacgggggcuacgucuccgggaucgcccagaccaacgccgagccggacggccccacccccgagcuggaggaggagauguucaagaagcggaaccucaccaucauggaccugcaccccggcagcgggaagacgcgcaaguaccugccggcgaucgugcgggaggccaucaagcgccggcuccgcacccugauccuggcccccacccggguggucgccgccgagauggaggaggcgcucaagggccugcccauccgcuaccagaccacggccaccaaguccgagcacaccgggcgggagaucguggaccugaugugccacgccaccuucacgaugcgccuccugagccccgugcgggucccgaacuacaaccugaucaucauggacgaggcccacuucaccgaccccgccuccaucgcggcccgcggcuacaucagcacccggguggggaugggcgaggccgccgcgaucuucaugaccgccacgccgcccggcaccgccgacgccuucccgcaguccaacgcccccauccaggacgaggagcgcgacauccccgagcgcagcuggaacuccgggaacgaguggaucaccgacuucgcgggcaagaccgugugguucguccccagcaucaaggccgggaacgacaucgccaacugccuccggaagaacggcaagaaggugauccagcugucccgcaagacguucgacaccgaguaccagaagaccaagcugaacgacugggacuucguggucaccacggacaucagcgagaugggggccaacuucaaggccgaccgggugaucgacccgcgccggugccucaagcccgugauccugaccgacggccccgagcgcgucauccuggcgggccccaugccggugaccgccgccuccgccgcccagcggcgcgggcgggugggccgcaacccccagaaggagaacgaccaguacaucuucaccgggcagccccucaacaacgacgaggaccacgcgcacuggaccgaggccaagaugcugcuggacaacaucaacacgcccgagggcaucaucccggcccucuucgagcccgagcgggagaaguccgccgcgaucgacggggaguaccgccugaagggcgagucccggaagaccuucgucgagcugaugcgccggggcgaccuccccguguggcuggccuacaaggucgccagcgaggggaucaaguacaccgaccgcaaguggugcuucgacggccagcggaacaaccagauccuggaggagaacauggacguggagaucuggaccaaggagggggagaagaagaagcuccgcccccgguggcuggacgcccgcacguacuccgacccgcuggcccucaaggaguucaaggacuucgcggccggccgcaagagcaucgcccuggaccuggugaccgagaucggccggguccccacccaccucgcccaccgcacccggaacgcccuggacaaccuggugaugcuccacacguccgagcacgggggcaaggcguaccgccacgccguggaggagcugcccgagaccauggagacccugcuccugcuggggcucaugauccugcugaccggcggggccaugcuguuccugaucagcggcaagggcaucgggaagacgagcaucggccugaucugcgucaucgccuccagcgggaugcucuggauggccgagaucccgcugcaguggaucgcguccgccaucgugcuggaguucuucaugauggugcuccugauccccgagcccgagaagcagcggacgccccaggacaaccagcuggccuacgucgugaucggcauccucacccuggccgccaucaucgcggccaacgagauggggcugcucgagaccacgaagcgcgaccugggcaugagccgggagccgggcguggucucccccaccagcuaccuggacguggaccuccaccccgccuccgccuggacccuguacgcgguggccaccacggucaucacccccaugcugcgccacaccaucgagaacagcaccgccaacgugucccucgccgccaucgcgaaccaggccgugguccugauggggcuggacaagggcuggccgaucagcaagauggaccucggggugccccugcuggcccucggcugcuacucccaggugaacccccugacgcugaccgccgccguccuccugcugaucacccacuacgcgaucaucgggcccggccuccaggccaaggccacccgggaggcccagaagcgcacggccgcgggcaucaugaagaacccgaccguggacgggaucaugaccaucgaccuggaccccgugaucuacgacagcaaguucgagaagcagcugggccaggucaugcuccuggugcugugcgccgugcagcuccugcugaugcggaccuccugggcccucugcgaggcccugacgcuggcgaccgggcccaucaccacccucugggagggcagccccggcaaguucuggaacacgaccaucgccgucuccauggccaacaucuuccgcgggagcuaccuggccggcgccgggcuggcguucuccaucaugaaguccgugggcaccgggaagcggggcaccggcucccagggggagacccucggcgagaaguggaagaagaagcugaaccagcugagccgcaaggaguucgaccucuacaagaaguccgggaucacggagguggaccggaccgaggccaaggagggccugaagaagggggagaucacccaccacgccgucucccgcggcagcgccaagcugcagugguucguggagcggaacauggugaucccggagggccgcgucaucgaccucgggugcggccgcgggggcugguccuacuacugcgccgggcugaagaaggugaccgaggugcgcggcuacacgaagggcgggcccggccacgaggagcccguccccaugagcaccuacggguggaacaucgugaagcugauguccggcaaggacguguucuaccucccgcccgagaagugcgacacccugcugugcgacaucggggagagcucccccagccccaccgucgaggagucccggacgauccgcgugcugaagaugguggagccguggcucaagaacaaccaguucugcaucaagguccugaaccccuacaugcccaccgugaucgagcaccuggagcgccuccagcggaagcacggcggcaugcuggugcgcaacccccugagccggaacuccacccacgagauguacuggaucagcaacgggaccggcaacaucgucgcguccgugaacauggugagccgccuccugcugaaccgguucacgaugacccaccgccggccgaccaucgagaaggacgucgaccucggggccggcacccgccacgugaacgccgagcccgagacgcccaacauggacgugaucggcgagcggaucaagcgcaucaaggaggagcacaacuccaccuggcacuacgacgacgagaacccguacaagaccugggccuaccacgggagcuacgaggucaaggccaccggcuccgcgagcuccaugaucaacgggguggucaagcugcugacgaagcccugggacguggugcccauggucacccagauggccaugaccgacaccacgcccuucggccagcagcggguguucaaggagaagguggacacccgcaccccgcggcccaugcccgggacccgccgggucaugggcaucacggccgaguggcucuggcgcacccugggccggaacaagaagccccgccugugcacccgggaggaguucaccaagaaggugcgcacgaacgccgcgaugggggccguguucaccgaggagaaccagugggacagcgccaaggccgccgucgaggacgaggacuucuggaagcucguggaccgcgagcgggagcugcacaagcugggcaagugcgggagcugcguguacaacaugaugggcaagcgcgagaagaagcucggggaguucggcaaggcgaagggcucccgggccaucugguacauguggcugggggcccgcuaccuggaguucgaggcccucggcuuccugaacgaggaccacugguucagccgggagaacuccuacagcggggucgagggcgaggggcugcacaagcucggcuacauccugcgcgacaucuccaagaucccgggcggggccauguacgcggacgacaccgccggcugggacacccggaucacggaggacgaccugcacaacgaggagaagaucacccagcagauggaccccgagcaccgccagcucgccaacgccaucuucaagcugaccuaccagaacaagguggugaagguccagcggcccacccccaccgggacggugauggacaucaucagccgcaaggaccagcggggcuccggccagguggggaccuacggccugaacaccuucaccaacauggaggcccagcucauccgccagauggagggggagggcguccugagcaaggcggaccuggagaacccgcaccuccccgagaagaagaucacgcaguggcuggagaccaaggggguggagcggcugaagcgcauggccaucuccggcgacgacugcguggucaagcccaucgacgaccgguucgccaacgcccuccuggcccugaacgacaugggcaaggugcgcaaggacaucccccaguggcagccgagcaagggguggcacgacuggcagcagguccccuucugcucccaccacuuccacgagcucaucaugaaggacggccggaagcuggucgugcccugccgcccccaggacgagcugaucgggcgggcgcgcaucagccagggcgccggguggucccuccgggagaccgccugccugggcaaggccuacgcgcagauguggagccugauguacuuccaccgccgcgaccuccggcuggccuccaacgccaucugcagcgccgugccgguccacugggugcccaccucccgcacgaccuggagcauccacgcccaccaccaguggaugaccaccgaggacaugcugacgguguggaaccgggucuggaucgaggacaaccccuggauggaggacaagacccccgugaccaccugggagaacgugccguaccucggcaagcgcgaggaccaguggugcgggucccugaucggccugacgagccgggcgaccugggcccagaacauccccaccgccauccagcagguccgcagccucaucgggaacgaggaguuccuggacuacaugcccuccaugaagcgguuccgcaaggaggaggagagcgagggcgccaucugguga

SEQ ID NO: 9910 - RNA, 9873 nt, Artificial Sequence
  derived and/or modified CDS sequence (opt1) from DENV-3__FJ898445__SS-prME
accagccugugccucaugaugauccugcccgccgcccuggcguuccaccucaccagccgggacggcgagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcggagcguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaaggccgugaucuucacgcugcugaugcucgugacccccagcaugaccaugcggugcgucggggugggcaaccgcgacuucguggagggccuguccggggccaccugggucgacguggugcuggagcacggcgggugcgucacgaccauggccaagaacaagcccacccucgacaucgagcugcagaagaccgaggcgacgcagcuggccacccuccggaagcugugcaucgagggcaagaucaccaacaucaccacggacagccgcugccccacccagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggcgagcaccaccgaggccauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgcgaagaagcaggagguggucgugcuggggucccaggagggcgccaugcacacggcccucaccggggccaccgagauccagaacagcggcgggaccuccaucuucgccggccaccugaagugccggcugaagauggacaagcucgagcugaagggcaugagcuacgcgaugugcacgaacaccuucgugcugaagaaggaggucuccgagacccagcacgggaccauccucaucaagguggaguacaagggcgaggacgugccgugcaagauccccuucagcacggaggacgggcagggcaaggcccacaacggccgccugaucaccgccaaccccgucgugaccaagcgggaggagcccgugaacaucgaggccgagccgcccuucggggagagcaacaucgucaucggcaucggggacaacgcgcugaagaucaacugguacaagaagggcuccagcaucgggaagauguucgaggccaccgcccgcggcgcccggcgcauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccggagcaccacccgcauggagaaccugcuguggaagcagaucgccaacgagcucaacuacauccugugggagaacaacaucaagcugaccgugguggucggggacaucaucggcgugcucgagcagggcaagcggacgcugacgccccagccgauggagcugaaguacuccuggaagaccugggggaaggccaagaucgugaccgccgagacgcagaacagcuccuucaucaucgacggccccaacacccccgagugccccagcgcgucccgcgccuggaacgucugggagguggaggacuacggguucggcguguucaccaccaacaucuggcucaagcugcgggaggucuacacccagcugugcgaccaccgccucaugagcgccgccgugaaggacgagcgggccgugcacgcggacaugggcuacuggauggagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaacuaccgcccgggcuaccacacccagacggccgggcccuggcaccucggcaagcuggagcuggacuucaacuacugcgagggcaccaccguggucaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccuggucuccgccggcagcggggagguggacaacuucaccaugggcgugcugugccucgcgauccuguucgaggaggucaugcgcgggaaguucggcaagaagcacaugaucgccgggguguucuucaccuucgugcugcuccuguccggccagaucaccuggcgggacauggcccacacgcugaucaugaucggcagcaacgccuccgaccgcauggggaugggcgucaccuaccucgcccugaucgcgaccuucaagauccagcccuuccuggcccucggguucuuccugcggaagcugaccagccgcgagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccaucuucacccugacgguggccuggcggaccgcgacccugauccucgccggggucagccugcugccggugugccaguccagcuccaugcgcaagaccgacuggcuccccaugacggucgccgccaugggcgugccgccccucccgcuguucaucuucagccucaaggacacccugaagcgccgguccuggccccugaacgagggggugauggccgucggccucgugagcauccuggcguccagccugcuccgcaacgacgugcccauggccggcccccuggucgccgggggccugcucaucgccugcuacgugaucaccgggaccuccgccgaccugacgguggagaaggcggccgacgucaccugggaggaggaggccgagcagaccggcgugagccacaaccugaugaucaccguggacgacgacgggaccaugcggaucaaggacgacgagacggagaacauccucaccguccugcugaagaccgcccuccugaucguguccggcaucuucccguacagcauccccgccacccugcucguguggcacacguggcagaagcagacccagcgcuccggcguccugugggacgugcccagcccgcccgagacccagaaggcggagcuggaggaggggguguaccggaucaagcagcagggcaucuucgggaagacccaggucggcgugggggugcagaaggagggcgucuuccacacgauguggcacgugacccgcggcgccgugcucaccuacaacgggaagcggcuggagcccaacugggccuccgucaagaaggaccugaucagcuacggcgggggcuggcgccucuccgcccaguggcagaagggggaggagguccaggugaucgcggucgagcccggcaagaaccccaagaacuuccagaccaugcccggcacguuccagaccaccaccggggagaucggcgccaucgcccuggacuucaagcccgggacgagcggcagccccaucaucaaccgggagggcaaggugguggggcuguacggcaacggggucgugaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggcgaucguccgcgaggccaucaagcggcgccuccggacccugauccuggcccccacccgcgugguggccgccgagauggaggaggcgcucaaggggcugcccauccgguaccagacgaccgccaccaaguccgagcacaccggccgcgagaucgucgaccugaugugccacgccacguucaccaugcggcuccugagccccgugcgcgugccgaacuacaaccugaucaucauggacgaggcccacuucaccgaccccgccuccaucgcggcccggggguacaucagcacccgcgucggcaugggcgaggccgccgcgaucuucaugacggccacgccgcccgggaccgccgacgccuucccgcaguccaacgcccccauccaggacgaggagcgcgacauccccgagcggagcuggaacuccggcaacgaguggaucaccgacuucgcggggaagacggugugguucgugcccagcaucaaggccggcaacgacaucgccaacugccuccgcaagaacgggaagaaggucauccagcugucccggaagaccuucgacaccgaguaccagaagaccaagcugaacgacugggacuucguggugacgaccgacaucagcgagaugggcgccaacuucaaggccgaccgcgucaucgacccgcggcgcugccucaagcccgugauccugaccgacggccccgagcgggugauccuggcggggcccaugccggucaccgccgccuccgccgcccagcgccggggccgcguggggcggaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgcgagaaguccgccgcgaucgacggcgaguaccggcugaagggcgagucccgcaagaccuucguggagcugaugcggcgcggggaccuccccgucuggcuggccuacaagguggccagcgagggcaucaaguacaccgaccggaaguggugcuucgacgggcagcgcaacaaccagauccuggaggagaacauggacgucgagaucuggacgaaggagggcgagaagaagaagcuccggccccgcuggcuggacgcccgcaccuacuccgacccgcuggcccucaaggaguucaaggacuucgcggccggccgcaagagcaucgcccuggaccuggugaccgagaucgggcgcgugcccacccaccucgcccaccggacgcgcaacgcccuggacaaccuggucaugcuccacaccuccgagcacggcgggaaggcguaccggcacgccguggaggagcugcccgagaccauggagacccugcuccugcugggccucaugauccugcugaccggcggggccaugcuguuccugaucagcgggaaggggaucggcaagaccagcaucgggcugaucugcgugaucgccuccagcggcaugcucuggauggccgagaucccgcugcaguggaucgcguccgccaucguccuggaguucuucaugauggugcuccugauccccgagcccgagaagcagcgcacgccccaggacaaccagcuggccuacguggucaucgggauccucacccuggccgccaucaucgcggccaacgagaugggcaugcuggagacgaccaagcgggaccucggcaugagcaaggagccggggguggccucccccaccagcuaccuggacguggaccugcaccccgccuccgcguggacccucuacgccgucgccacgaccgugaucacccccaugcugcgccacaccaucgagaacagcacggccaacgugucccuggccgcgaucgccaaccaggccgucgugcucaugggccuggacaagggguggccgaucagcaagauggaccugggcgugccccuccuggcccuggggugcuacucccaggucaacccccucacccugaccgccgcggugcugcuccugaucacccacuacgccaucaucggccccggccugcaggccaaggccacgcgggaggcccagaagcgcaccgcggccgggaucaugaagaacccgaccguggacggcaucaugaccaucgaccucgaccccgucaucuacgacagcaaguucgagaagcagcugggccaggugaugcugcucgugcugugcgccguccagcugcuccugaugcggacguccugggcccugugcgaggcgcucacccuggccaccggccccaucaccacgcugugggagggcagccccgggaaguucuggaacaccaccaucgccguguccauggccaacaucuuccgcggcagcuaccucgccggggcgggccuggccuucuccaucaugaaguccguggggaccggcaagcggggcaccgggucccagggcgagacgcugggggagaaguggaagaagaagcucaaccagcugagccgcaaggaguucgaccuguacaagaaguccggcaucaccgaggucgaccggaccgaggccaaggaggggcucaagcgcggcgagaucacccaccacgccgugucccggggcagcgccaagcugcagugguucguggagcgcaacauggucaucccggaggggcgggugaucgaccugggcugcgggcgcggcgggugguccuacuacugcgcgggccucaagaaggugacggagguccggggcuacaccaagggcgggcccgggcacgaggagcccgugcccaugagcaccuacggcuggaacaucgugaagcugauguccgggaaggacgucuucuaccugccgcccgagaagugcgacacccuccugugcgacaucggcgagagcucccccagccccacgguggaggagucccgcaccauccgcgugcugaagauggucgagccguggcugaagaacaaccaguucugcaucaaggugcucaaccccuacaugcccaccgugaucgagcaccuggagcggcugcagcgcaagcacggcgggaugcucguccggaacccccugagccgcaacuccacccacgagauguacuggaucagcaacggcacggggaacaucguggccuccgugaacauggucagccggcugcuccugaaccgcuucaccaugacccaccggcgcccgaccaucgagaaggacguggaccugggcgccggcacgcggcacgugaacgccgagcccgagacccccaacauggacgucaucggggagcgcaucaagcggaucaaggaggagcacaacuccaccuggcacuacgacgacgagaacccguacaagaccugggccuaccacggcagcuacgaggugaaggcgacgggguccgccagcuccaugaucaacggcguggucaagcuccugaccaagcccugggacgugguccccauggugauccagauggccaugaccgacaccacgcccuucgggcagcagcgcguguucaaggagaaggucgacacccggaccccgcgcagcaugcccggcacccggcgcgugaugggcaucacggccgaguggcuguggcggacccucgggcgcaacaagaagccccggcugugcacccgcgaggaguucacccgcaaggugcggacgaacgcggccaugggcgccgucuucaccgaggagaaccagugggacagcgccaaggccgcgguggaggacgaggacuucuggaagcugguggaccgcgagcgggagcuccacaagcuggggaagugcggcuccugcgucuacaacaugauggggaagcgcgagaagaagcugggcgaguucggcaaggccaaggggagccgggccaucugguacauguggcucggcgcccgcuaccuggaguucgaggcccugggguuccucaacgaggaccacugguucucccgggagaacagcuacuccggcguggagggggagggccugcacaagcugggcuacauccuccgcgacaucagcaagauccccgggggcgcgauguacgccgacgacaccgccgggugggacacccggaucacggaggacgaccugcacaacgaggagaagaucacccagcagauggacccggagcaccgccagcuggccaacgccaucuucaagcucaccuaccagaacaagguggucaaggugcagcggcccacccccaccggcacggugauggacaucaucucccgcaaggaccagcggggcagcgggcaggucggcaccuacgggcugaacaccuucaccaacauggaggcgcagcugauccgccagauggagggcgagggggugcucuccaaggccgaccuggagaacccccaccuccccgagaagaagaucacgcaguggcucgagaccaagggcguggagcggcugaagcgcauggccaucagcggcgacgacugcgucgugaagcccaucgacgaccgguucgccaacgcccugcucgcgcugaacgacauggggaaggugcgcaaggacaucccccaguggcagcccuccaagggcuggcacgacuggcagcaggucccguucugcagccaccacuuccacgagcugaucaugaaggacgggcggaagcucguggugcccugccgcccccaggacgagcugaucggccgggcccgcaucucccagggggccggcuggagccugcgcgagaccgccugccucggcaaggcguacgcccagauguggucccugauguacuuccaccggcgcgaccugcggcucgccagcaacgccaucugcuccgccguccccgugcacugggugccgaccagccgcacgaccugguccauccacgcgcaccaccaguggaugaccaccgaggacaugcugacggucuggaaccggguguggaucgaggacaaccccuggauggaggacaagacccccgugaccaccugggagaacguccccuaccuggggaagcgcgaggaccaguggugcggcagccucaucgggcugacgagccgggccaccugggcccagaacaucccgaccgccauccagcagguccgcucccugaucggcaacgaggaguuccucgacuacaugcccagcaugaagcgguuccgcaaggaggaggaguccgagggggccaucugguga

SEQ ID NO: 9911 - RNA, 9873 nt, Artificial Sequence
  derived and/or modified CDS sequence (opt1) from DENV-3__GQ868571__SS-prME
accagccugugccucaugaugauccugcccgccgcccuggcguuccaccucaccagccgggacggggagccgcggaugaucguggggaagaacgagcggggcaagagccugcuguucaagaccgccagcgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaaggccgugaucuucauccugcugaugcucgugacgcccagcaugaccaugcggugcgugggggugggcaaccgcgacuucguggagggccuguccggggccaccugggucgacguggugcuggagcacggcgggugcgucaccacgauggccaagaacaagcccacccucgacaucgagcugcagaagaccgaggcgacccagcuggccacgcuccggaagcugugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgcgaagaagcaggagguggucgugcuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcggggagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccguggccuggcgcacggcgacccugauccucgccggggucagccugcugccggugugccaguccagcuccaugcggaagaccgacuggcuccccaugaccgucgccgccaugggcgugccgccccucccgcuguucaucuucagccucaaggacacgcugaagcgccgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugaccguggagaaggcggccgacgucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagacgaccaccggggagaucggcgccaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggcgaucguccgggaggccaucaagcgccggcuccgcacccugauccuggcccccacccgggugguggccgccgagauggaggaggcgcucaaggggcugcccauccgcuaccagaccacggccaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgcggcccgcggguacaucagcacccgggucggcaugggcgaggccgccgcgaucuucaugaccgccacgccgcccgggaccgccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacgcccgaggggaucaucccggcccucuucgagcccgagcgggagaaguccgccgcgaucgacggcgaguaccgccugaagggcgagucccggaagaccuucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggacuucgcggccggccgcaagagcaucgcccuggaccuggugaccgagaucgggcgggugcccacccaccucgcccaccgcacccggaacgcccuggacaaccuggucaugcuccacacguccgagcacggcgggaaggcguaccgccacgccguggaggagcugcccgagaccauggagacccugcuccugcugggccucaugauccugcugaccgggggcgccaugcuguuccugaucagcggcaaggggaucggcaagacgagcaucgggcugaucugcgugaucgccuccagcggcaugcucuggauggccgagaucccgcugcaguggaucgcguccgccaucguccuggaguucuucaugauggugcuccugauccccgagcccgagaagcagcggacgccccaggacaaccagcuggccuacguggucaucgggauccucacccuggccgccaucaucgcggccaacgagaugggcaugcuggagaccacgaagcgcgaccucggcaugagcaaggagccggggguggugucccccaccagcuaccuggacgucgaccugcaccccgccuccgccuggacccucuacgcgguggccaccacggugaucacccccaugcugcggcacaccaucgagaacagcaccgccaacgucucccuggccgccaucgcgaaccaggccguggugcucaugggccuggacaagggguggccgaucagcaagauggaccugggcgucccccuccuggcccuggggugcuacucccaggugaacccccucacgcugaccgccgccgugcugcuccugaucacccacuacgcgaucaucggccccggccugcaggccaaggccacccgcgaggcccagaagcggacggccgcggggaucaugaagaacccgaccgucgacggcaucaugaccaucgaccucgaccccgugaucuacgacagcaaguucgagaagcagcugggccaggugaugcugcucguccugugcgccgugcagcugcuccugaugcgcaccuccugggcccugugcgaggcccucacgcuggcgaccggccccaucaccacccugugggagggcagccccgggaaguucuggaacacgaccaucgccguguccauggccaacaucuuccggggcagcuaccucgccggggccggccuggcguucuccaucaugaaguccgucgggaccggcaagcgcggcaccgggucccagggcgagacccugggggagaaguggaagaagaagcucaaccagcugagccggaaggaguucgaccuguacaagaaguccggcaucacggagguggaccgcaccgaggccaaggaggggcucaagcggggcgagaucacccaccacgccgugucccgcggcagcgccaagcugcagugguucgucgagcggaacauggugaucccggaggggcgcgugaucgaccugggcugcgggcggggcgggugguccuacuacugcgccggccucaagaaggucaccgaggugcgcggcuacacgaagggcgggcccgggcacgaggagcccgugcccaugagcaccuacggcuggaacaucgucaagcugauguccgggaaggacguguucuaccugccgcccgagaagugcgacacccuccugugcgacaucggcgagagcucccccagccccaccguggaggagucccggacgauccgcguccugaagaugguggagccguggcugaagaacaaccaguucugcaucaaggugcucaaccccuacaugcccaccgucaucgagcaccuggagcgccugcagcggaagcacggcgggaugcucgugcgcaacccccugagccggaacuccacccacgagauguacuggaucagcaacggcaccgggaacaucguggcguccgucaacauggugagccgccugcuccugaaccgguucacgaugacccaccgccggccgaccaucgagaaggacguggaccugggcgccggcacccgccacgucaacgccgagcccgagacgcccaacauggacgugaucggggagcggaucaagcgcaucaaggaggagcacaacuccaccuggcacuacgacgacgagaacccguacaagaccugggccuaccacggcagcuacgaggugaaggccaccggguccgcgagcuccaugaucaacggcgucgugaagcuccugacgaagcccugggacgucgugcccauggugacccagauggccaugaccgacaccacgcccuucgggcagcagcgggucuucaaggagaagguggacacccgcaccccgcggagcaugcccggcacccgccgggugaugggcaucacggccgaguggcuguggcgcacccucgggcggaacaagaagccccgccugugcacccgggaggaguucaccaagaagguccgcacgaacgccgcgaugggcgccguguucaccgaggagaaccagugggacagcgccaaggccgccguggaggacgaggacuucuggaagcuggucgaccgcgagcgggagcuccacaagcuggggaagugcggcuccugcguguacaacaugauggggaagcgcgagaagaagcugggcgaguucggcaaggcgaaggggagccgggccaucugguacauguggcucggcgcccgcuaccuggaguucgaggcccugggguuccucaacgaggaccacugguucucccgggagaacagcuacuccggcguggagggggagggccugcacaagcugggcuacauccuccgcgacaucagcaagauccccgggggcgccauguacgcggacgacaccgccgggugggacacccggaucacggaggacgaccugcacaacgaggagaagaucacccagcagauggacccggagcaccgccagcuggccaacgccaucuucaagcucaccuaccagaacaaggucgugaaggugcagcggcccacccccaccggcacggucauggacaucaucucccgcaaggaccagcggggcagcggccaggugggcaccuacgggcugaacaccuucaccaacauggaggcccagcugauccgccagauggagggcgagggggugcucuccaaggcggaccuggagaacccccaccuccccgagaagaagaucacgcaguggcuggagaccaagggcgucgagcggcugaagcgcauggccaucagcggcgacgacugcguggugaagcccaucgacgaccgguucgccaacgcccugcucgcccugaacgacauggggaagguccgcaaggacaucccccaguggcagcccuccaagggcuggcacgacuggcagcaggucccguucugcagccaccacuuccacgagcugaucaugaaggacgggcggaagcucgugguccccugccgcccccaggacgagcugaucggccgggcgcgcaucucccagggggccggcuggagccugcgggagaccgccugccucggcaaggccuacgcgcagauguggucccugauguacuuccaccgccgcgaccugcggcucgccagcaacgccaucugcuccgccgugcccgugcacugggucccgaccagccgcacgaccugguccauccacgcccaccaccaguggaugaccaccgaggacaugcugacgguguggaaccggguguggaucgaggacaaccccuggauggaggacaagacccccgucaccaccugggagaacgugcccuaccuggggaagcgcgaggaccaguggugcggcagccucaucgggcugacgagccgggcgaccugggcccagaacaucccgaccgccauccagcagguccgcucccugaucggcaacgaggaguuccucgacuacaugcccagcaugaagcgguuccgcaaggaggaggaguccgagggggccaucugguga

SEQ ID NO: 9912 - RNA, 9873 nt, Artificial Sequence
  derived and/or modified CDS sequence (opt1) from DENV-3__GU131951__SS-prME
accagccugugccucaugaugauccugcccgcggcccuggcguuccaccucaccagccgggacggcgagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgaugagcaagaacaagcccacccucgacaucgagcugcagaagaccgaggccacccagcuggccacgcuccggaagcugugcaucgagggcaagaucaccaacaucaccaccgacucccgcugccccacgcagggcgaggcggugcugccggaggagcaggaccagaacuacgucugcaagcacaccuacguggaccggggguggggcaacgggugcggccucuucgggaagggcagccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccuccaccaccgaggccauccugcccgaguacggcacccuggggcucgagugcagcccgcgcaccggccuggacuucaacgagaugauccugcucacgaugaagaacaaggcguggauggugcaccggcagugguucuucgaccugccccugcccuggaccuccggcgccaccaccgagacgcccaccuggaaccgcaaggagcuccuggugaccuucaagaacgcccacgccaagaagcaggaggucguggugcuggggagccaggagggcgccaugcacaccgcgcucacgggggccaccgagauccagaacuccggcgggaccagcaucuucgccggccaccugaagugccggcugaagauggacaagcucgagcugaagggcauguccuacgccaugugcaccaacacguucguccugaagaaggaggugagcgagacccagcacgggaccauccucaucaagguggaguacaagggcgaggacgucccgugcaagauccccuucagcaccgaggacgggcagggcaaggcccacaacggccgccugaucacggcgaaccccguggugaccaagaaggaggagcccgucaacaucgaggccgagccgcccuucggggaguccaacaucgugaucggcaucggggacaacgcccugaagaucaacugguacaagaagggcagcuccaucgggaagauguucgaggccaccgcgcggggcgcccgccggauggccauccugggcgacaccgccugggacuucgggagcgugggcgggguccucaacucccugggcaagauggugcaccagaucuucgggagcgccuacacggcgcuguucuccggcgugagcugggucaugaagaucggcaucggggugcuccugaccuggaucggccugaacuccaagaacaccagcauguccuucagcugcaucgccaucgggaucaucacccucuaccugggcgccgugguccaggccgacauggggugcgugaucaacuggaagggcaaggagcugaagugcggcuccgggaucuucgugacgaacgagguccacaccuggaccgagcaguacaaguuccaggccgacagccccaagcgccucgcgaccgccaucgccggcgccugggagaacggggugugcggcauccgcuccacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacagcuggaagaccugggggaaggcgaagaucgucaccgccgagacccagaacuccagcuucaucaucgacggccccaacacgcccgagugccccuccgccagccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagucccagaagaacgggagcuggaagcuggagaaggccucccugaucgaggugaagaccugcacguggcccaagucccacacccucugguccaacggcgugcuggagagcgacaugaucauccccaagucccuggcggggcccaucagccagcacaacuaccggccgggcuaccacacccagaccgccgggcccuggcaccucggcaagcuggagcuggacuucaacuacugcgagggcacgaccgucgugaucaccgagaacugcgggacccgcggccccucccuccggacgaccaccgugagcgggaagcugauccacgaguggugcugccgcuccugcacccugcccccgcuccgguacaugggcgaggacgggugcugguacggcauggagauccgccccaucagcgagaaggaggagaacauggucaagucccuggugagcgccggcuccggggagguggacaacuucacgaugggcguccugugccucgccauccuguucgaggaggugaugcgggggaaguucggcaagaagcacaugaucgccgggguguucuucaccuucguccugcuccugagcggccagaucaccuggcgcgacauggcgcacacccugaucaugaucggcuccaacgccagcgaccggauggggaugggcgugacguaccucgcccugaucgccaccuucaagauccagcccuuccuggcccucggguucuuccugcgcaagcugaccagccgggagaaccuccugcugggcgugggccucgcgauggccaccacgcugcagcugcccgaggacaucgagcagauggccaacgggaucgcccucggccugauggcgcugaagcucaucacccaguucgagaccuaccagcuguggaccgcccugaucucccucacgugcagcaacaccaucuucacccugaccgucgccuggcgcacggccacccugauccucgccggggugucccugcugccggucugccagagcuccagcaugcggaagaccgacuggcuccccaugaccguggcggccaugggcgugccgccccucccgcuguucaucuucucccucaaggacacgcugaagcgccgcagcuggccccugaacgagggggucauggccgugggccucguguccauccuggccagcucccugcuccggaacgacguccccauggccggcccccugguggccggcgggcugcucaucgccugcuacgugaucaccgggaccagcgccgaccugaccgucgagaaggccgccgacgugacgugggaggaggaggcggagcagaccggggugucccacaaccugaugaucaccgucgacgacgacgggaccaugcgcaucaaggacgacgagaccgagaacauccucacggugcugcugaagaccgcccuccugaucgugagcggcaucuucccguacuccauccccgccacccugcucgucuggcacaccuggcagaagcagacgcagcggagcggcgugcugugggacgugcccagcccgcccgaggcccagaaggccgagcuggaggagggggucuaccgcaucaagcagcagggcaucuucgggaagacccaggugggcguggggguccagaaggagggcguguuccacaccauguggcacgugacccggggcgcgguccucacguacaacgggaagcgccuggagcccaacugggccagcgugaagaaggaccugaucuccuacggcgggggcuggcggcucagcgcccaguggcagaagggggaggaggugcaggucaucgccguggagcccggcaagaaccccaagaacuuccagaccaugcccggcaccuuccagaccacgaccggggagaucggcgcgaucgcccuggacuucaagcccgggaccagcggcucccccaucaucaaccgcgagggcaagguggucgggcuguacggcaacgggguggugaccaagaacggcggguacgucagcggcaucgcccagacgaacgccgagccggacggccccacccccgagcuggaggaggagauguucaagaagcggaaccucaccaucauggaccugcaccccggguccggcaagacccgcaaguaccugccggccaucgugcgggaggcgaucaagcgccggcuccgcacgcugauccuggcccccacccggguggucgccgccgagauggaggaggcccucaaggggcugcccauccgcuaccagaccaccgcgaccaagagcgagcacaccggccgggagaucguggaccugaugugccacgccaccuucaccaugcgccuccugucccccgugcgggucccgaacuacaaccugaucaucauggacgaggcccacuucacggaccccgccagcaucgccgcgcgcggguacaucuccacccgggugggcaugggcgaggccgccgccaucuucaugaccgcgacgccgcccgggacggccgacgccuucccgcagagcaacgcccccauccaggacgaggagcgcgacauccccgagcgcuccuggaacagcggcaacgaguggaucaccgacuucgccgggaagaccgugugguucguccccuccaucaaggcgggcaacgacaucgccaacugccuccggaagaacgggaagaaggugauccagcugagccgcaagaccuucgacacggaguaccagaagaccaagcugaacgacugggacuucguggucaccaccgacaucuccgagaugggcgccaacuucaaggccgaccgggugaucgacccgcgccggugccucaagcccgugauccugacggacggccccgagcgcgucauccuggccgggcccaugccggugaccgcggccagcgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagagccggaagacguucgucgagcugaugcgccgcggggaccuccccguguggcuggcgcacaaggucgccuccgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacagcgacccgcuggcccucaaggaguucaaggacuucgccgcgggccgcaaguccaucgcccuggaccuggugacggagaucgggcggguccccagccaccucgcccaccgcacccggaacgcccuggacaaccuggugaugcuccacaccagcgagcacggcgggaaggccuaccgccacgcgguggaggagcugcccgagaccauggagacgcugcuccugcugggccucaugauccugcugaccgggggcgccaugcuguuccugaucuccggcaaggggaucggcaagaccagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacgcuggccgccaucaucgccgcgaacgagaugggccugcucgagaccaccaagcgcgaccugggcaugagcaaggagccggggguggucucccccaccagcuaccuggacguggaccuccaccccgccuccgccuggacgcuguacgccguggcgaccaccgucaucacccccaugcugcggcacacgaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacccugaccgccgccguccuccugcugaucacgcacuacgccaucaucggccccggccuccaggcgaaggccacccgcgaggcccagaagcggaccgccgccgggaucaugaagaacccgaccguggacggcaucaugacgaucgaccuggaccccgugaucuacgacagcaaguucgagaagcagcuggggcaggucaugcuccuggugcugugcgcggugcagcuccugcugaugcgcaccuccugggcccucugcgaggcccugacccuggccaccggccccaucacgacccucugggagggcagccccgggaaguucuggaacaccaccaucgcggucuccauggccaacaucuuccggggcagcuaccuggccggggccggccuggccuucuccaucaugaaguccguggggacgggcaagcgcggcaccgggagccagggcgagacccucggggagaaguggaagaagaagcugaaccagcugucccggaaggaguucgaccucuacaagaaguccggcaucaccgagguggaccgcaccgaggcgaaggaggggcugaagcggggcgagaucacgcaccacgccgucucccgcggcagcgccaagcugcagugguucguggagcggaacauggugaccccggaggggcgcgucaucgaccucggcugcgggcggggcgggugguccuacuacugcgccggccugaagaaggugaccgaggugcgcggcuacaccaagggcgggcccgggcacgaggagcccguccccaugagcacguacggcuggaacaucgugaagcugauguccgggaaggacguguucuaccucccgcccgagaagugcgacacccugcugugcgacaucggcgagagcucccccagccccaucgucgaggagucccggaccauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacgcacgagauguacuggaucagcaacggcaccgggaacaucgucgccuccgugaacauggugagccgccuccugcugaaccgguucaccaugacccaccgccggccgacgaucgagaaggacgucgaccucggcgcgggcacccgccacgugaacgccgagcccgagacccccaacauggacgugaucggggagcggaucaagcgcaucaaggaggagcacaacuccaccuggcacuacgacgacgagaacccguacaagacgugggccuaccacggcagcuacgaggucaaggccaccggguccgccagcagcaugaucaacggcguggucaagcugcugaccaagcccugggacguggugcccauggucacccagauggcgaugacggacaccacccccuucgggcagcagcggguguucaaggagaagguggacacccgcacgccgcgguccaugcccggcacccgccgggucaugggcaucaccgccgaguggcucuggcgcacccuggggcggaacaagaagccccgccugugcacgcgggaggaguucaccaagaaggugcgcaccaacgccgccaugggcgcgguguucaccgaggagaaccagugggacagcgccaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacacggcggggugggacacccggaucaccgaggacgaccugcacaacgaggagaagaucacccagcagauggacccggagcaccgccagcucgccaacgccaucuucaagcugacguaccagaacaagguggugaagguccagcggcccacccccaccggcaccgugauggacaucaucucccgcaaggaccagcggggcagcggccaggugggcaccuacgggcugaacacguucaccaacauggaggcccagcucauccgccagauggagggcgaggggguccuguccaaggccgaccuggagaacccccaccucccggagaagaagaucacccaguggcuggagaccaagggcguggagcggcugaagcgcauggcgaucagcggcgacgacugcguggucaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcccgcaucucccagggggcgggcuggagccuccgggagacggccugccugggcaaggccuacgcccagauguggucccugauguacuuccaccgccgcgaccuccggcuggcgagcaacgccaucugcuccgccgugcccguccacugggugccgaccagccgcaccaccuggagcauccacgcccaccaccaguggaugacgaccgaggacaugcugaccguguggaaccgggucuggaucgaggacaaccccuggauggaggacaagacccccgugacgaccugggagaacgugcccuaccucgggaagcgcgaggaccaguggugcggcucccugaucgggcugaccagccgggccaccugggcgcagaacaucccgacggccauccagcagguccgcucccucaucggcaacgaggaguuccuggacuacaugcccagcaugaagcgguuccgcaaggaggaggaguccgagggggccaucugguga

SEQ ID NO: 9913 - RNA, 9873 nt, Artificial Sequence
  derived and/or modified CDS sequence (opt1) from DENV-3__GQ868572__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaaggccgugaucuucauccugcugaugcucgugacgcccagcaugaccaugcggugcgucggggugggcaaccgcgacuucguggagggccuguccggggccaccugggucgacguggugcuggagcacggcgggugcgucaccacgauggccaagaacaagcccacccucgacaucgagcugcagaagaccgaggcgacccagcuggccacgcuccggaagcugugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgcgaagaagcaggagguggucgugcuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggaggucuccgagacccagcacgggaccauccucaucaagguggaguacaagggcgaggacgugccgugcaagauccccuucagcaccgaggacgggcagggcaagguccacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccacccaccucgcccaccgcacccggaacgcccuggacaaccuggugaugcuccacacguccgagcacggcgggaaggccuaccgccacgcgguggaggagcugcccgagaccauggagacccugcuccugcugggccucaugauccugcugaccgggggcgccaugcuguuccugaucagcggcaaggggaucggcaagacgagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcaugagcaaggagccggggguggucucccccaccagcuaccuggacguggaccuccaccccgccuccgccuggacccuguacgccguggcgaccacggucaucacccccaugcugcggcacaccaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacagcaaguucgagaagcagcuggggcaggucaugcuccuggugcugugcgcggugcagcuccugcugaugcgcaccuccugggcccucugcgaggcccugacgcuggccaccggccccaucaccacccucugggagggcagccccgggaaguucuggaacacgaccaucgcggucuccauggccaacaucuuccggggcagcuaccuggccggggccggccuggccuucuccaucaugaaguccguggggaccggcaagcgcggcaccgggucccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgucucccgcggcagcgccaagcugcagugguucguggagcggaacauggugaucccggaggggcgcgucaucgaccucggcugcgggcggggcgggugguccuacuacugcgccggccugaagaaggugaccgaggugcgcggcuacacgaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccaccgucgaggagucccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacccacgagauguacuggaucagcaacggcaccgggaacaucgucgccuccgugaacauggugagccgccuccugcugaaccgguucacgaugacccaccgccggccgaccaucgagaaggacgucgaccucggcgcgggcacccgccacgugaacgccgagcccgagacgcccaacauggacgugaucggggagcggaucaagcgcaucaaggaggagcacaacuccaccuggcacuacgacgacgagaacccguacaagaccugggccuaccacggcagcuacgaggucaaggccaccggguccgccagcuccaugaucaacggcguggucaagcugcugacgaagcccugggacguggugcccauggucacccagauggcgaugaccgacaccacgcccuucgggcagcagcggguguucaaggagaagguggacacccgcaccccgcggagcaugcccggcacccgccgggucaugggcaucacggccgaguggcucuggcgcacccuggggcggaacaagaagccccgccugugcacccgggaggaguucaccaagaaggugcgcacgaacgccgccaugggcgcgguguucaccgaggagaaccagugggacagcgccaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggugaagguccagcggcccacccccaccggcacggugauggacaucaucucccgcaaggaccagcggggcagcggccaggugggcaccuacgggcugaacaccuucaccaacauggaggcccagcucauccgccagauggagggcgaggggguccuguccaaggccgaccuggagaacccccaccucccggagaagaagaucacgcaguggcuggagaccaagggcguggagcggcugaagcgcauggcgaucagcggcgacgacugcguggucaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcccgcaucucccagggggcgggcuggagccuccgggagaccgccugccugggcaaggccuacgcccagauguggucccugauguacuuccaccgccgcgaccuccggcuggcgagcaacgccaucugcuccgccgugcccguccacugggugccgaccagccgcacgaccugguccauccacgcccaccaccaguggaugaccaccgaggacaugcugacgguguggaaccgggucuggaucgaggacaaccccuggauggaggacaagacccccgugaccaccugggagaacgugcccuaccucgggaagcgcgaggaccaguggugcggcagccugaucgggcugacgagccgggccaccugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 9914 - RNA, 9873 nt, Artificial Sequence
  derived and/or modified CDS sequence (opt1) from DENV-3__GQ868573__SS-prME
accagcuucugccucaugaugauccuccccgcggcccuggcguuccaccugaccagccgggacggggagccccggaugaucguggggaagaacgagcggggcaagagccuccuguucaagaccgccagcgggaucaacaugugcacccugaucgccauggaccucggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcguggcccuggcgccccacgugggcauggggcucgacacccgcacccagaccuggaugagcgccgagggcgccuggcgccagguggagaaggucgagacgugggcccugcgccacccgggguucaccauccuggcccucuuccuggcccacuacaucggcaccucccugacccagaaggccgugaucuucauccuccugaugcuggugacgcccagcaugaccaugcggugcgucggggugggcaaccgcgacuucguggagggccucuccggggccaccugggucgacguggugcuggagcacggcgggugcgucaccacgauggccaagaacaagcccacccuggacaucgagcuccagaagaccgaggcgacccagcuggccacgcugcggaagcucugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccuguucgggaagggcucccucgugaccugcgccaaguuccagugccuggagcccaucgagggcaaggugguccaguacgagaaccugaaguacaccgugaucaucacggugcacaccggggaccagcaccaggucggcaacgagacccagggggugaccgccgagaucacgccccaggcgagcaccaccgaggccauccuccccgaguacggcacccuggggcuggagugcuccccgcgcaccggccucgacuucaacgagaugauccugcugacgaugaagaacaaggccuggaugguccaccggcagugguucuucgaccucccccugcccuggaccagcggcgccaccaccgagacgcccaccuggaaccgcaaggagcugcucgugaccuucaagaacgcccacgcgaagaagcaggagguggucgugcuggggucccaggagggcgccaugcacaccgcccugacgggggccaccgagauccagaacagcggcgggaccuccaucuucgccggccaccucaagugccggcugaagauggacaagcuggagcucaagggcaugagcuacgcgaugugcaccaacacguucgugcugaagaaggaggucuccgagacccagcacgggaccauccugaucaagguggaguacaagggcgaggacgugccgugcaagauccccuucagcaccgaggacgggcagggcaaggcccacaacggccgccucaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcugaacagccucggcaagaugguccaccagaucuucggguccgccuacacggcccuguucagcggcguguccugggugaugaagaucggcaucgggguccugcucaccuggaucggccugaacagcaagaacaccuccaugagcuucuccugcaucgccaucgggaucaucacccuguaccucggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccuggccaccgccaucgccggcgcgugggagaacggggucugcggcauccgcagcacgacccggauggagaaccuccuguggaagcagaucgccaacgagcugaacuacauccucugggagaacaacaucaagcugaccgugguggucggggacaucaucggcgugcuggagcagggcaagcgcacccucacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcugaagcuccgcgaggucuacacccagcugugcgaccaccggcugaugagcgccgccgugaaggacgagcgcgccgugcacgcggacaugggcuacuggaucgagagccagaagaacggguccuggaagcucgagaaggccagccugaucgaggucaagaccugcacguggccgaagucccacacccuguggagcaacggcgugcucgaguccgacaugaucauccccaagagccuggccgggcccaucucccagcacaacuaccggccgggcuaccacacccagaccgccgggcccuggcaccugggcaagcucgagcuggacuucaacuacugcgagggcacgaccguggucaucaccgagaacugcgggacccgcggccccagccugcggacgaccaccguguccgggaagcucauccacgaguggugcugccgcagcugcacccugcccccgcugcgguacaugggcgaggacgggugcugguacggcauggagauccgccccaucuccgagaaggaggagaacauggucaagagccucgucuccgccggcagcggggagguggacaacuucacgaugggcgugcugugccuggcgauccucuucgaggaggucaugcgggggaaguucggcaagaagcacaugaucgccgggguguucuucaccuucgugcugcugcucuccggccagaucaccuggcgcgacauggcccacacccugaucaugaucggcagcaacgccuccgaccggauggggaugggcgucacguaccuggcccucaucgcgaccuucaagauccagcccuuccuggcccugggguucuuccuccgcaagcugaccagccgggagaaccugcuccugggcgugggccuggccauggccaccacgcuccagcugcccgaggacaucgagcagauggcgaacgggaucgcccugggccucauggcccugaagcugaucacccaguucgagaccuaccagcucuggaccgcccugaucagccugacgugcuccaacaccaucuucacccucaccguggccuggcgcacggcgacccugauccuggccggggucagccuccugccggugugccaguccagcuccaugcggaagaccgacuggcugcccaugaccgucgccgccaugggccugccgccccucccgcuguucaucuucagccucaaggacacgcugaagcgccgcuccuggccccugaacgagggggugauggccgugggccucgucagcauccuggcguccagccugcuccggaacgacgugcccauggccggcccccugguggccgggggccugcucaucgccugcuacgucaucaccgggaccuccgccgaccugaccguggagaaggcggccgacgugacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggcggagcuggaggaggggguguaccgcaucaagcagcagggcaucuucgggaagacccaggugggcgucggggugcagaaggagggcguguuccacaccauguggcacgucacgcggggcgccgugcucaccuacaacgggaagcgccuggagcccaacugggccuccgugaagaaggaccugaucagcuacggcgggggcuggcggcucuccgcccaguggcagaagggggaggagguccaggugaucgcgguggagcccggcaagaaccccaagaacuuccagaccaugcccggcaccuuccagacgaccaccggggagaucggcgccaucgcccuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggcgaucgugcgggaggccaucaagcgccggcuccgcacccugauccuggcccccacccgggucguggccgccgagauggaggaggcgcucaaggggcugcccauccgcuaccagaccacggccaccaaguccgagcacaccggccgggagaucguggaccugaugugccacgccaccuucacgaugcgccuccugagccccguccgggugccgaacuacaaccugaucaucauggacgaggcccacuucaccgaccccgccuccaucgcggcccgcggguacaucagcacccgggugggcaugggcgaggccgccgcgaucuucaugaccgccacgccgcccgggaccgccgacgccuucccgcaguccaacgcccccauccaggacgaggagcgcgacauccccgagcgcagcuggaacuccggcaacgaguggaucaccgacuucgcggggaagaccgucugguucgugcccagcaucaaggccggcaacgacaucgccaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggcggggcccaugccggugaccgccgccuccgccgcccagcggcgcggccgggucgggcgcaacccccagaaggagaacgaccaguacaucuucaccggccagccccucaacaacgacgaggaccacgcgcacuggaccgaggccaagaugcugcuggacaacaucaacacgcccgaggggaucaucccggcccucuucgagcccgagcgggagaaguccgccgcgaucgacggcgaguaccgccugaagggcgagucccggaagaccuucguggagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgcggccggccgcaagagcaucgcccuggaccuggucaccgagaucgggcgggugcccacccaccucgcccaccgcacccggaacgcccuggacaaccuggugaugcuccacacguccgagcacggcgggaaggcguaccgccacgccgucgaggagcugcccgagaccauggagacccugcuccugcugggccucaugauccugcugaccgggggcgccaugcuguuccugaucagcggcaaggggaucggcaagacgagcaucgggcugaucugcgugaucgccuccagcggcaugcucuggauggccgagaucccgcugcaguggaucgcguccgccaucgugcuggaguucuucaugaugguccuccugauccccgagcccgagaagcagcggacgccccaggacaaccagcuggccuacguggugaucgggauccucacccuggccgccaucaucgcggccaacgagaugggccugcucgagaccacgaagcgcgaccugggcaugagcaaggagccgggggucgugucccccaccagcuaccuggacguggaccuccaccccgccuccgccuggacccuguacgcggucgccaccacggugaucacccccaugcugcggcacaccaucgagaacagcaccgccaacgugucccucgccgccaucgcgaaccaggccgucgugcugaugggccuggacaagggguggccgaucagcaagauggaccucggcgugccccugcuggcccucgggugcuacucccaggucaacccccugacgcugaccgccgccgugcuccugcugaucacccacuacgcgaucaucggccccggccuccaggccaaggccacccgcgaggcccagaagcggacggccgcggggaucaugaagaacccgaccguggacggcaucaugaccaucgaccuggaccccgucaucuacgacagcaaguucgagaagcagcugggccaggugaugcuccuggugcugugcgccguccagcuccugcugaugcgcaccuccugggcccucugcgaggcccugacgcuggcgaccggccccaucaccacccucugggagggcagccccgggaaguucuggaacacgaccaucgccguguccauggccaacaucuuccggggcagcuaccuggccggggccggccuggcguucuccaucaugaaguccguggggaccggcaagcgcggcaccgggucccagggcgagacccucggggagaaguggaagaagaagcugaaccagcugagccggaaggaguucgaccucuacaagaaguccggcaucacggaggucgaccgcaccgaggccaaggaggggcugaagcggggcgagaucacccaccacgccgugucccgcggcagcgccaagcugcagugguucguggagcggaacauggucaucccggaggggcgcgugaucgaccucggcugcgggcggggcgggugguccuacuacugcgccggccugaagaaggugaccgagguccgcggcuacacgaagggcgggcccgggcacgaggagcccgugcccaugagcaccuacggcuggaacaucgugaagcugauguccgggaaggacgucuucuaccucccgcccgagaagugcgacacccugcugugcgacaucggcgagagcucccccagccccaccguggaggagucccggacgauccgcgugcugaagauggucgagccguggcucaagaacaaccaguucugcaucaaggugcugaaccccuacaugcccaccgugaucgagcaccuggagcgccuccagcggaagcacggcgggaugcugguccgcaacccccugagccggaacuccacccacgagauguacuggaucagcaacggcaccgggaacaucguggcguccgugaacauggucagccgccuccugcugaaccgguucacgaugacccaccgccggccgaccaucgagaaggacguggaccucggcgccggcacccgccacgugaacgccgagcccgagacgcccaacauggacgucaucggggagcggaucaagcgcaucaaggaggagcacaacuccaccuggcacuacgacgacgagaacccguacaagaccugggccuaccacggcagcuacgaggugaaggccaccggguccgcgagcuccaugaucaacggcguggucaagcugcugacgaagcccugggacgugguccccauggugacccagauggccaugaccgacaccacgcccuucgggcagcagcggguguucaaggagaaggucgacacccgcaccccgcggagcaugcccggcacccgccgggugaugggcaucacggccgaguggcucuggcgcacccuggggcggaacaagaagccccgccugugcacccgggaggaguucaccaagaaggugcgcacgaacgccgcgaugggcgccgucuucaccgaggagaaccagugggacagcgccaaggccgccguggaggacgaggacuucuggaagcucguggaccgcgagcgggagcugcacaagcuggggaagugcggcuccugcgucuacaacaugauggggaagcgcgagaagaagcucggcgaguucggcaaggcgaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgcggacgacaccgccgggugggacacccggaucacggaggacgaccugcacaacgaggagaagaucacccagcagauggacccggagcaccgccagcucgccaacgccaucuucaagcugaccuaccagaacaagguggucaaggugcagcggcccacccccaccggcacggugauggacaucaucucccgcaaggaccagcggggcagcgggcaggucggcaccuacgggcugaacaccuucaccaacauggaggcccagcucauccgccagauggagggcgagggggugcuguccaaggcggaccuggagaacccccaccucccggagaagaagaucacgcaguggcuggagaccaagggcguggagcggcugaagcgcauggccaucagcggcgacgacugcgucgugaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcugguggugcccugccgcccccaggacgagcugaucggccgggcgcgcaucucccagggggccggcuggagccuccgggagaccgccugccugggcaaggccuacgcgcagauguggucccugauguacuuccaccgccgcgaccuccggcuggccagcaacgccaucugcuccgccguccccgugcacugggugccgaccagccgcacgaccugguccauccacgcccaccaccaguggaugaccaccgaggacaugcugacggucuggaaccggguguggaucgaggacaaccccuggauggaggacaagacccccgugaccaccugggagaacguccccuaccucgggaagcgcgaggaccaguggugcggcagccugaucgggcugacgagccgggcgaccugggcccagaacaucccgaccgccauccagcagguccgcucccucaucggcaacgaggaguuccuggacuacaugcccagcaugaagcgguuccgcaaggaggaggaguccgagggggccaucugguga

SEQ ID NO: 9915 - RNA, 9873 nt, Artificial Sequence
  derived and/or modified CDS sequence (opt1) from DENV-3__GQ868574__SS-prME
accucccugugccucaugaugauccugcccgccgcccuggcguuccaccucaccucccgggacggggagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaaggccgugaucuucauccugcugaugcucgugacgcccagcaugaccaugcggugcgucggggugggcaaccgcgacuucguggagggccuguccggggccaccugggucgacguggugcuggagcacggcgggugcgucaccacgauggccaagaacaagcccacccucgacaucgagcugcagaagaccgaggcgacccagcuggccacgcuccggaagcugugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgcgaagaagcaggagguggucgugcuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucagcuacugcgagggcacgaccguggucaucaccgagaacugcgggacccgcggccccucccuccggacgaccaccgugagcgggaagcugauccacgaguggugcugccgcuccugcacccugcccccgcuccgguacaugggcgaggacgggugcugguacggcauggagauccgccccaucagcgagaaggaggagaacauggugaagucccuggucagcgccggcuccggggagguggacaacuucacgaugggcgugcugugccucgcgauccuguucgaggaggucaugcgggggaaguucggcaagaagcacaugaucgccgggguguucuucaccuucgugcugcuccugagcggccagaucaccuggcgcgacauggcccacacccugaucaugaucggcuccaacgccagcgaccggauggggaugggcgucacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucucccucacgugcagcaacaccaucuucacccugaccguggccuggcgcacggcgacccugauccucgccggggucucccugcugccggugugccagagcuccagcaugcggaagaccgacuggcuccccaugaccgucgccgccaugggcgugccgccccucccgcuguucaucuucucccucaaggacacgcugaagcgccgcagcuggccccugaacgagggggugauggccgucggccucguguccauccuggcgagcucccugcuccggaacgacgugcccauggccggcccccuggucgccgggggccugcucaucgccugcuacgugaucaccgggaccagcgccgaccugaccguggagaaggcggccgacgucacgugggaggaggaggccgagcagaccggcgugucccacaaccugaugaucaccguggacgacgacgggaccaugcgcaucaaggacgacgagaccgagaacauccucacgguccugcugaagaccgcccuccugaucgugagcggcaucuucccguacuccauccccgccacccugcucguguggcacaccuggcagaagcagacgcagcggagcggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccagcgucaagaaggaccugaucuccuacggcgggggcuggcggcucagcgcccaguggcagaagggggaggagguccaggugaucgcggucgagcccggcaagaaccccaagaacuuccagaccaugcccggcaccuuccagacgaccaccggggagaucggcgccaucgcccuggacuucaagcccgggaccagcggcucccccaucaucaaccgcgagggcaaggugguggggcuguacggcaacggggucgugacgaagaacggcggguacgugagcggcaucgcccagaccaacgccgagccggacggccccacccccgagcuggaggaggagauguucaagaagcggaaccucaccaucauggaccugcaccccggguccggcaagacgcgcaaguaccugccggcgaucguccgggaggccaucaagcgccggcuccgcacccugauccuggcccccacccgggugguggccgccgagauggaggaggcgcucaaggggcugcccauccgcuaccagaccacggccaccaagagcgagcacaccggccgggagaucgucgaccugaugugccacgccaccuucacgaugcgccuccugucccccgugcgggugccgaacuacaaccugaucaucauggacgaggcccacuucaccgaccccgccagcaucgcggcccgcggguacaucuccacccgggucggcaugggcgaggccgccgcgaucuucaugaccgccacgccgcccgggaccgccgacgccuucccgcagagcaacgcccccauccaggacgaggagcgcgacauccccgagcgcuccuggaacagcggcaacgaguggaucaccgacuucgcggggaagaccgugugguucgugcccuccaucaaggccggcaacgacaucgccaacugccuccggaagaacgggaagaaggucauccagcugagccgcaagacguucgacaccgaguaccagaagaccaagcugaacgacugggacuucguggugaccacggacaucuccgagaugggcgccaacuucaaggccgaccgggucaucgacccgcgccggugccucaagcccgugauccugaccgacggccccgagcgcgugauccuggcggggcccaugccggucaccgccgccagcgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacgcccgaggggaucaucccggcccucuucgagcccgagcgggagaaguccgccgcgaucgacggcgaguaccgccugaagggcgagagccggaagaccuucguggagcugaugcgccgcggggaccuccccgucuggcuggcccacaagguggccuccgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacagcgacccgcuggcccucaaggaguucaaggacuucgcggccggccgcaaguccaucgcccuggaccuggugaccgagaucgggcgggugcccacccaccucgcccaccgcacccggaacgcccuggacaaccuggucaugcuccacacgagcgagcacggcgggaaggcguaccgccacgccguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucguccuggaguucuucaugauggugcuccugauccccgagcccgagaagcagcggacgccccaggacaaccagcuggccuacguggucaucgggauccucacccuggccgccaucaucgcggccaacgagaugggcaugcuggagaccacgaagcgcgaccucggcauguccaaggagccggggguggccagccccaccuccuaccuggacguggaccugcaccccgccagcgcguggacccucuacgccgucgccaccacggugaucacccccaugcugcggcacaccaucgagaacuccaccgccaacgugagccuggccgcgaucgccaaccaggccgucgugcucaugggccuggacaagggguggccgaucuccaagauggaccugggcgugccccuccuggcccuggggugcuacagccaggucaacccccucacgcugaccgccgcggugcugcuccugaucacccacuacgccaucaucggccccggccugcaggccaaggccacccgcgaggcccagaagcggacggcggccgggaucaugaagaacccgaccguggacggcaucaugaccaucgaccucgaccccgucaucuacgacuccaaguucgagaagcagcugggccaggugaugcugcucgugcugugcgccguccagcugcuccugaugcgcaccagcugggcccugugcgaggcgcucacgcuggccaccggccccaucaccacccugugggagggcucccccgggaaguucuggaacacgaccaucgccgugagcauggccaacaucuuccggggcuccuaccucgccggggcgggccuggccuucagcaucaugaaguccguggggaccggcaagcgcggcaccgggagccagggcgagacccugggggagaaguggaagaagaagcucaaccagcugagccggaaggaguucgaccuguacaagaaguccggcaucacggaggucgaccgcaccgaggccaaggaggggcucaagcggggcgagaucacccaccacgccgugagccgcggcuccgccaagcugcagugguucguggagcggaacauggucaucccggaggggcgcgugaucgaccugggcugcgggcggggcggguggagcuacuacugcgcgggccucaagaaggugaccgagguccgcggcuacacgaagggcgggcccgggcacgaggagcccgugcccauguccaccuacggcuggaacaucgugaagcugaugagcgggaaggacgucuucuaccugccgcccgagaagugcgacacccuccugugcgacaucggcgaguccagccccucccccaccguggaggagagccggacgauccgcgugcugaagauggucgagccguggcugaagaacaaccaguucugcaucaaggugcucaaccccuacaugcccaccgugaucgagcaccuggagcgccugcagcggaagcacggcgggaugcucguccgcaacccccugucccggaacagcacccacgagauguacuggaucuccaacggcaccgggaacaucguggccagcgugaacauggucucccgccugcuccugaaccgguucacgaugacccaccgccggccgaccaucgagaaggacguggaccugggcgccggcacccgccacgugaacgccgagcccgagacgcccaacauggacgucaucggggagcggaucaagcgcaucaaggaggagcacaacagcaccuggcacuacgacgacgagaacccguacaagaccugggccuaccacggcuccuacgaggugaaggcgaccgggagcgccuccagcaugaucaacggcguggucaagcuccugacgaagcccugggacgugguccccauggugacccagauggccaugaccgacaccacgcccuucgggcagcagcggguguucaaggagaaggucgacacccgcaccccgcggagcaugcccggcacccgccgggugaugggcaucacggccgaguggcuguggcgcacccucgggcggaacaagaagccccgccugugcacccgggaggaguucaccaagaaggugcgcacgaacgcggccaugggcgccgucuucaccgaggagaaccagugggacuccgccaaggccgcgguggaggacgaggacuucuggaagcugguggaccgcgagcgggagcuccacaagcuggggaagugcggcagcugcgucuacaacaugauggggaagcgcgagaagaagcugggcgaguucggcaaggccaaggggucccgggccaucugguacauguggcucggcgcccgcuaccuggaguucgaggcccugggguuccucaacgaggaccacugguucagccgggagaacuccuacagcggcguggagggggagggccugcacaagcugggcuacauccuccgcgacaucuccaagauccccgggggcgcgauguacgccgacgacaccgccgggugggacacccggaucacggaggacgaccugcacaacgaggagaagaucacccagcagauggacccggagcaccgccagcuggccaacgccaucuucaagcucaccuaccagaacaagguggucaaggugcagcggcccacccccaccggcacggugauggacaucaucagccgcaaggaccagcggggcuccgggcaggucggcaccuacgggcugaacaccuucaccaacauggaggcgcagcugauccgccagauggagggcgagggggugcucagcaaggccgaccuggagaacccccaccuccccgagaagaagaucacgcaguggcuggagaccaagggcguggagcggcugaagcgcauggccaucuccggcgacgacugcgucgugaagcccaucgacgaccgguucgccaacgcccugcucgcgcugaacgacauggggaaggugcgcaaggacaucccccaguggcagcccagcaagggcuggcacgacuggcagcaggucccguucugcucccaccacuuccacgagcugaucaugaaggacgggcggaagcucguggugcccugccgcccccaggacgagcugaucggccgggcccgcaucagccagggggccggcuggucccugcgggagaccgccugccucggcaaggcguacgcccagauguggagccugauguacuuccaccgccgcgaccugcggcucgccuccaacgccaucugcagcgccguccccgugcacugggugccgaccucccgcacgaccuggagcauccacgcgcaccaccaguggaugaccaccgaggacaugcugacggucuggaaccggguguggaucgaggacaaccccuggauggaggacaagacccccgugaccaccugggagaacguccccuaccuggggaagcgcgaggaccaguggugcggcagccucaucgggcugacgucccgggccaccugggcccagaacaucccgaccgccauccagcagguccgcagccugaucggcaacgaggaguuccucgacuacaugcccuccaugaagcgguuccgcaaggaggaggagagcgagggggccaucugguga

SEQ ID NO: 9916 - RNA, 9873 nt, Artificial Sequence
  derived and/or modified CDS sequence (opt1) from DENV-3__GQ868575__SS-prME
accagccugugccucaugaugauccugcccgccgcccuggcguuccaccucaccagccgggacggcgagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaaggccgugaucuucauccugcugaugcucgugacgcccagcaugaccaugcggugcgucggggugggcaaccgcgacuucguggagggccuguccggggccaccugggucgacguggugcuggagcacggcgggugcgucaccacgauggccaagaacaagcccacccucgacaucgagcugcagaagaccgaggcgacccagcuggccacgcuccggaagcugugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgcgaagaagcaggagguggucgugcuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacuucagcuucaucaucgacggccccaacacgcccgagugccccuccgcgagccgggccuggaacgucugggagguggaggacuacggguucggcguguucaccaccaacaucuggcucaagcugcgcgaggucuacacccagcugugcgaccaccggcucauguccgccgccgugaaggacgagcgcgccgugcacgcggacaugggcuacuggaucgagagccagaagaacgggagcuggaagcuggagaaggccucccugaucgaggucaagaccugcacguggcccaagagccacacccucugguccaacggcgugcuggagagcgacaugaucauccccaagucccuggccgggcccaucagccagcacaacuaccggccgggcuaccacacccagaccgccgggcccuggcaccucggcaagcuggagcuggacuucaacuacugcgagggcacgaccguggucaucaccgagaacugcgggacccgcggccccucccuccggacgaccaccgugagcgggaagcugauccacgaguggugcugccgcuccugcacccugcccccgcuccgguacaugggcgaggacgggugcugguacggcauggagauccgccccaucagcgagaaggaggagaacauggugaagucccuggucagcgccggcuccggggagguggacaacuucacgaugggcgugcugugccucgcgauccuguucgaggaggucaugcgggggaaguucggcaagaagcacaugaucgccgggguguucuucaccuucgugcugcuccugagcggccagaucaccuggcgcgacauggcccacacccugaucaugaucggcuccaacgccagcgacaagauggggaugggcgucacguaccucgcccugaucgcgaccuucaagauccagcccuuccuggcccucggguucuuccugcggaagcugaccucccgcgagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcagcaacaccaucuucacccugaccguggccuggcggacggcgacccugauccucgccggggucucccugcugccggugugccagagcuccagcaugcgcaagaccgacuggcuccccaugaccgucgccgccaugggcgugccgccccucccgcuguucaucuucgggcucaaggacacgcugaagcggcgcuccuggccccugaacgagggcgugauggccgucggccucgugagcauccuggcguccagccugcuccgcaacgacgugcccauggccgggccccuggucgccggcgggcugcucaucgccugcuacgugaucaccggcaccuccgccgaccugaccguggagaaggcggccgacgucacgugggaggaggaggccgagcagaccggggugagccacaaccugaugaucaccguggacgacgacggcaccaugcggaucaaggacgacgagaccgagaacauccucacgguccugcugaagaccgcccuccugaucguguccggcaucuucccguacagcauccccgccacccugcucguguggcacaccuggcagaagcagacgcagcgcuccgggguccugugggacgugcccagcccgcccgagacccagaaggcggagcuggaggagggcguguaccggaucaagcagcaggggaucuucggcaagacccaggucggggugggcgugcagaaggagggcgucuuccacaccauguggcacgugacgcgcggggccgugcucaccuacaacggcaagcggcuggagcccaacugggccuccgucaagaaggaccugaucagcuacgggggcggguggcgccucuccgcccaguggcagaagggcgaggagguccaggugaucgcggucgagcccggcaagaaccccaagaacuuccagaccaugcccgggaccuuccagacgaccaccggcgagaucggggccaucgcccuggacuucaagcccggcaccagcggcucccccaucaucaaccgggaggggaagguggugggccuguacgggaacggcgucgugacgaagaacgggggcuacgugagcggcaucgcccagaccaacgccgagccggacgggcccacccccgagcuggaggaggagauguucaagaagcgcaaccucaccaucauggaccugcaccccggcagcgggaagacgcggaaguaccugccggcgaucguccgcgaggccaucaagcggcgccuccggacccugauccuggcccccacccgcgugguggccgccgagauggaggaggcgcucaagggccugcccauccgguaccagaccacggccaccaaguccgagcacaccgggcgcgagaucgucgaccugaugugccacgccaccuucacgaugcggcuccugagccccgugcgcgugccgaacuacaaccugaucaucauggacgaggcccacuucaccgaccccgccuccaucgcggcccggggcuacaucagcacccgcgucggcaugggggaggccgccgcgaucuucaugaccgccacgccgcccggcaccgccgacgccuucccgcaguccaacgcccccauccaggacgaggagcgggacauccccgagcgcagcuggaacuccgggaacgaguggaucaccgacuucgcgggcaagaccgugugguucgugcccagcaucaaggccgggaacgacaucgccaacugccuccgcaagaacggcaagaaggucauccagcugucccggaagacguucgacaccgaguaccagaagaccaagcugaacgacugggacuucguggugaccacggacaucagcgagaugggcgccaacuucaaggccgaccgcgucaucgacccgcggcgcugccucaagcccgugauccugaccgacgggcccgagcgggugauccuggcgggccccaugccggucaccgccgccuccgccgcccagcgccgggggcgcgugggccggaacccccagaaggagaacgaccaguacaucuucaccgggcagccccucaacaacgacgaggaccacgcgcacuggaccgaggccaagaugcugcuggacaacaucaacacgcccgagggcaucaucccggcccucuucgagcccgagcgcgagaaguccgccgcgaucgacggcgaguaccggcugaagggggagucccgcaagaccuucguggagcugaugcggcgcggcgaccuccccgucuggcuggcccacaagguggccagcgaggggaucaaguacaccgaccggaaguggugcuucgacggccagcgcaacaaccagauccuggaggagaacauggacgucgagaucuggaccaaggagggcgagaagaagaagcuccggccccgcuggcuggacgcccggacguacuccgacccgcuggcccucaaggaguucaaggacuucgcggccgggcgcaagagcaucgcccuggaccuggugaccgagaucggccgcgugcccacccaccucgcccaccggacccgcaacgcccuggacaaccuggucaugcuccacacguccgagcacgggggcaaggcguaccggcacgccguggaggagcugcccgagaccauggagacccugcuccugcuggggcucaugauccugcugaccggcggcgccaugcuguuccugaucagcgggaagggcaucgggaagacguccaucggccugaucugcgugaucgccagcagcgggaugcucuggauggccgagaucccgcugcaguggaucgcguccgccaucguccuggaguucuucaugauggugcuccugauccccgagcccgagaagcagcgcacgccccaggacaaccagcuggccuacguggucaucggcauccucacccuggccgccaucaucgcggccaacgagaugggccugcucgagaccacgaagcgggaccuggggaugagccgcgagccgggcguggugucccccaccagcuaccuggacgucgaccuccaccccgccuccgccuggacccuguacgcgguggccaccacggugaucacccccaugcugcggcacaccaucgagaacagcaccgccaacgucucccucgccgccaucgcgaaccaggccguggugcugauggggcuggacaagggcuggccgaucagcaagauggaccucggggucccccugcuggcccucggcugcuacucccaggugaacccccugacgcugaccgccgccgugcuccugcugaucacccacuacgcgaucaucggccccgggcuccaggccaaggccacccgcgaggcccagaagcggacggccgcgggcaucaugaagaacccgaccgucgacgggaucaugaccaucgaccuggaccccgugaucuacgacagcaaguucgagaagcagcugggccaggugaugcuccugguccugugcgccgugcagcuccugcugaugcgcaccuccugggcccucugcgaggcccugacgcuggcgaccggccccaucaccacccucugggaggggagccccggcaaguucuggaacacgaccaucgccguguccauggccaacaucuuccgggggagcuaccuggccggcgccgggcuggcguucuccaucaugaaguccgucggcaccggcaagcgcgggaccggcucccagggggagacccucggcgagaaguggaagaagaagcugaaccagcugagccggaaggaguucgaccucuacaagaaguccgggaucacggagguggaccgcaccgaggccaaggagggccugaagcggggcgagaucacccaccacgccgugagccgcgggagcgccaagcugcagugguucgucgagcggaacauggugaucccggagggccgcgugaucgaccucgggugcggccgcgggggcugguccuacuacugcgccggccugaagaaggucaccgaggugcgcggguacacgaagggcgggcccggccacgaggagcccgugcccaugagcaccuacggguggaacaucgucaagcugauguccggcaaggacguguucuaccucccgcccgagaagugcgacacccugcugugcgacaucggcgagagcucccccagccccaccguggaggagucccggacgauccgcguccugaagaugguggagccguggcucaagaacaaccaguucugcaucaaggugcugaaccccuacaugcccaccgucaucgagcaccuggagcgccuccagcggaagcacgggggcaugcuggugcgcaacccccugagccggaacuccacccacgagauguacuggaucagcaacgggaccggcaacaucguggcguccgucaacauggugagccgccuccugcugaaccgguucacgaugacccaccgccggccgaccaucgagaaggacguggaccucggcgccgggacccgccacgucaacgccgagcccgagauccccaacauggacgugaucggcgagcggaucaagcgcaucaaggaggagcacaacuccacguggcacuacgacgacgagaacccguacaagaccugggccuaccacgggagcuacgaggugaaggccaccggcuccgcgagcuccaugaucaacggggucgugaagcugcugaccaagcccugggacgucgugcccauggugacgcagauggccaugaccgacaccacccccuucggccagcagcgggucuucaaggagaagguggacacgcgcaccccgcggagcaugcccggcacccgccgggugauggggaucaccgccgaguggcucuggcgcacgcugggccggaacaagaagccccgccugugcacccgggaggaguucaccaagaagguccgcaccaacgccgcgaugggggccguguucacggaggagaaccagugggacuccgccaaggccgccguggaggacgaggacuucuggaagcucgucgaccgcgagcgggagcugcacaagcugggcaagugcgggagcugcguguacaacaugaugggcaagcgcgagaagaagcucggcgaguucgggaaggcgaagggcagccgggccaucugguacauguggcugggggcccgcuaccuggaguucgaggcccucggcuuccugaacgaggaccacugguucucccgggagaacagcuacuccgggguggagggcgagggccugcacaagcucggguacauccugcgcgacaucagcaagauccccggcggggccauguacgcggacgacaccgccggcugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaccggcaccgucauggacaucaucucccgcaaggaccagcgggggagcggccagguggggacguacggccugaacaccuucaccaacauggaggcccagcucauccgccagauggagggggagggcgugcuguccaaggcggaccuggagaacccccaccucccggagaagaagaucacccaguggcuggagacgaagggcgucgagcggcugaagcgcauggccaucagcggggacgacugcguggugaagcccaucgacgaccgguucgccaacgcccuccuggcccugaacgacaugggcaagguccgcaaggacaucccccaguggcagcccuccaagggguggcacgacuggcagcaggucccguucugcagccaccacuuccacgagcucaucaugaaggacggccggaagcuggugguccccugccgcccccaggacgagcugaucgggcgggcgcgcaucucccagggcgccggcuggagccuccgggagaccgccugccuggggaaggccuacgcgcagauguggucccugauguacuuccaccgccgcgaccuccggcuggccagcaacgccaucugcuccgccgugcccgugcacugggucccgaccagccgcaccacgugguccauccacgcccaccaccaguggaugaccaccgaggacaugcugaccguguggaaccggguguggaucgaggacaaccccuggauggaggacaagacgcccgucaccaccugggagaacgugcccuaccucggcaagcgcgaggaccaguggugcgggagccugaucggccugaccucccgggcgacgugggcccagaacaucccgaccgccauccagcagguccgcagccucaucgggaacgaggaguuccuggacuacaugcccagcaugaagcgguuccgcaaggaggaggaguccgagggcgccaucugguga

SEQ ID NO: 9917 - RNA, 9873 nt, Artificial Sequence
  derived and/or modified CDS sequence (opt1) from DENV-3__GU131953__SS-prME
accagccugugccucaugaugauccugcccgccgcccuggcguuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgggacaagcggagcguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaaggccgugaucuucauccugcugaugcucgugacgcccagcaugaccaugcggugcgucggggugggcaaccgcgacuucguggagggccuguccggggccaccugggucgacguggugcuggagcacggcgggugcgucaccacgauggccaagaacaagcccacccucgacaucgagcugcagaagaccgaggcgacccagcuggccacgcuccggaagcugugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgcgaagaagcaggagguggucgugcuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacgccgugcuggaguccgacaugaucauccccaagagccuggccggccccaucucccagcacaacuaccggccgggguaccacacccagaccgccggccccuggcaccucgggaagcuggagcuggacuucaacuacugcgagggcacgaccguggucaucaccgagaacugcggcacccgcgggcccagccuccggacgaccaccguguccggcaagcugauccacgaguggugcugccgcagcugcacccugcccccgcuccgguacaugggggaggacggcugcugguacgggauggagauccgccccaucuccgagaaggaggagaacauggucaagagccuggucuccgcgggcagcggcgagguggacaacuucacgaugggggugcugugccucgccauccuguucgaggaggucaugcggggcaaguucgggaagaagcacaugaucgccggcguguucuucaccuucgugcugcuccuguccgggcagaucaccuggcgcgacauggcccacacccugaucaugaucggcagcaacgccuccgaccggaugggcaugggggucacguaccucgcgcugaucgccaccuucaagauccagcccuuccuggcccucggcuucuuccugcgcaagcugaccagccgggagaaccuccugcugggggugggccucgccauggcgaccacgcugcagcugcccgaggacaucgagcagauggccaacggcaucgcccucgggcugauggcccugaagcucaucacccaguucgagaccuaccagcuguggaccgcccugaucagccucacgugcuccaacaccaucuucacccugaccguggcguggcgcacggccacccugauccucgccggcgucagccugcugccggugugccaguccagcuccaugcggaagaccgacuggcuccccaugaccgucgccgccaugggggugccgccccucccgcuguucaucuucagccucaaggacacgcugaagcgccgcuccuggccccugaacgagggcgugauggcggucgggcucgugagcauccuggccuccagccugcuccggaacgacgugcccauggccggcccccuggucgccggcgggcugcucaucgccugcuacgugaucaccggcaccuccgcggaccugaccguggagaaggccgccgacgucacgugggaggaggaggccgagcagaccggggugagccacaaccugaugaucaccguggacgacgacggcaccaugcgcaucaaggacgacgagaccgagaacauccucacgguccugcugaagaccgcccuccugaucguguccgggaucuucccguacagcauccccgcgacccugcucguguggcacaccuggcagaagcagacgcagcgguccggcguccugugggacgugcccagcccgcccgagacccagaaggccgagcuggaggagggcguguaccgcaucaagcagcaggggaucuucggcaagacccaggucggggugggcgugcagaaggagggggucuuccacaccauguggcacgugacgcggggcgccgugcucaccuacaacggcaagcgccuggagcccaacugggccuccgucaagaaggaccugaucagcuacgggggcggguggcggcucuccgcgcaguggcagaagggcgaggagguccaggugaucgccgucgagcccgggaagaaccccaagaacuuccagaccaugcccggcaccuuccagacgaccaccggcgagaucggggccaucgcccuggacuucaagcccggcaccagcgggagccccaucaucaaccgcgagggcaagguggugggccuguacgggaacggcgucgugacgaagaacgggggcuacguguccgggaucgcccagaccaacgcggagccggacggccccacccccgagcuggaggaggagauguucaagaagcggaaccucaccaucauggaccugcaccccggcagcgggaagacgcgcaaguaccugccggccaucguccgggaggccaucaagcgccggcuccgcacccugauccuggcccccacccgggugguggccgcggagauggaggaggcccucaagggccugcccauccgcuaccagaccacggccaccaaguccgagcacaccgggcgggagaucgucgaccugaugugccacgccaccuucacgaugcgccuccugagccccgugcgggugccgaacuacaaccugaucaucauggacgaggcccacuucaccgaccccgcguccaucgccgcccgcggcuacaucagcacccgggucgggaugggcgaggccgcggccaucuucaugaccgccacgccgcccggcaccgccgacgccuucccgcaguccaacgcgcccauccaggacgaggagcgcgacauccccgagcgcagcuggaacuccgggaacgaguggaucaccgacuucgccggcaagaccgugugguucgugcccagcaucaaggccgggaacgacaucgccaacugccuccggaagaacggcaagaaggucauccagcugucccgcaagacguucgacaccgaguaccagaagaccaagcugaacgacugggacuucguggugaccacggacaucagcgagaugggggccaacuucaaggcggaccgggucaucgacccgcgccggugccucaagcccgugauccugaccgacggccccgagcgcgugauccuggccggccccaugccggucaccgccgccuccgccgcgcagcggcgcgggcgggugggccgcaacccccagaaggagaacgaccaguacaucuucaccgggcagccccucaacaacgacgaggaccacgcccacuggaccgaggccaagaugcugcuggacaacaucaacacgcccgagggcaucaucccggcccucuucgagcccgagcgggagaaguccgcggccaucgacggggaguaccgccugaagggcgagucccggaagaccuucguggagcugaugcgccggggcgaccuccccgucuggcuggcccacaagguggccagcgaggggaucaaguacaccgaccgcaaguggugcuucgacggccagcggaacaaccagauccuggaggagaacauggacgucgagaucuggaccaaggagggggagaagaagaagcuccgcccccgguggcuggacgcccgcacguacuccgacccgcuggcgcucaaggaguucaaggacuucgccgccggccgcaagagcaucgcccuggaccuggugaccgagaucggccgggugcccacccaccucgcccaccgcacccggaacgcgcuggacaaccuggucaugcuccacacguccgagcacgggggcaaggccuaccgccacgccguggaggagcugcccgagaccauggagacccugcuccugcuggggcucaugauccugcugaccggcggggccaugcuguuccugaucagcggcaagggcaucgggaagacgagcaucggccugaucugcgugaucgccuccagcgggaugcucuggauggcggagaucccgcugcaguggaucgccuccgccaucguccuggaguucuucaugauggugcuccugauccccgagcccgagaagcagcggacgccccaggacaaccagcuggccuacguggucaucggcauccucacccuggccgcgaucaucgccgccaacgagauggggcugcucgagaccacgaagcgcgaccugggcaugagcaaggagccgggcguggugucccccaccagcuaccuggacgucgaccuccaccccgccuccgcguggacccuguacgccguggccaccacggugaucacccccaugcugcggcacaccaucgagaacagcaccgccaacgucucccucgccgcgaucgccaaccaggccguggugcugauggggcuggacaagggcuggccgaucagcaagauggaccucggggucccccugcuggcccucggcugcuacucccaggugaacccccugacgcugaccgccgcggugcuccugcugaucacccacuacgccaucaucgggcccggccuccaggccaaggccacccgcgaggcccagaagcggacggcggccggcaucaugaagaacccgaccgucgacgggaucaugaccaucgaccuggaccccgugaucuacgacagcaaguucgagaagcagcugggccaggugaugcuccugguccugugcgccgugcagcuccugcugaugcgcaccuccugggcccucugcgaggcgcugacgcuggccaccgggcccaucaccacccucugggagggcagccccggcaaguucuggaacacgaccaucgccguguccauggccaacaucuuccgggggagcuaccuggccggcgcggggcuggccuucuccaucaugaaguccgucggcaccgggaagcgcggcaccggcucccagggggagacccucggcgagaaguggaagaagaagcugaaccagcugagccggaaggaguucgaccucuacaagaaguccgggaucacggagguggaccgcaccgaggccaaggagggccugaagcgcggggagaucacccaccacgccgugucccgcggcagcgccaagcugcagugguucgucgagcggaacauggugaucccggagggccgcgugaucgaccucgggugcggccgcgggggcugguccuacuacugcgcggggcugaagaaggucaccgaggugcgcggcuacacgaagggcgggcccggccacgaggagcccgugcccaugagcaccuacggguggaacaucgucaagcugauguccggcaaggacguguucuaccucccgcccgagaagugcgacacccugcugugcgacaucggggagagcucccccagccccaccguggaggagucccggacgauccgcguccugaagaugguggagccguggcucaagaacaaccaguucugcaucaaggugcugaaccccuacaugcccaccgucaucgagcaccuggagcgccuccagcggaagcacggcggcaugcuggugcgcaacccccugagccggaacuccacccacgagauguacuggaucagcaacgggaccggcaacaucguggccuccgucaacauggugagccgccuccugcugaaccgguucacgaugacccaccgccggccgaccaucgagaaggacguggaccucggggccggcacccgccacgucaacgccgagcccgagacgcccaacauggacgugaucggcgagcggaucaagcgcaucaaggaggagcacaacuccaccuggcacuacgacgacgagaacccguacaagaccugggccuaccacgggagcuacgaggugaaggcgaccggcuccgccagcuccaugaucaacggggucgugaagcugcugacgaagcccugggacgucgugcccauggugacccagauggccaugaccgacaccacgcccuucggccagcagcgggucuucaaggagaagguggacacccgcaccccgcggagcaugcccgggacccgccgggugauggagaucacggccgaguggcucuggcgcacccugggccggaacaagaagccccgccugugcacccgggaggaguucaccaagaagguccgcacgaacgcggccaugggcgccguguucaccgaggagaaccagugggacagcgccaaggccgcgguggaggacgaggacuucuggaagcucgucgaccgcgagcgggagcugcacaagcuggggaagugcggcuccugcguguacaacaugauggggaagcgcgagaagaagcucggcgaguucgggaaggccaagggcagccgggccaucugguacauguggcugggcgcccgcuaccuggaguucgaggcccucggguuccugaacgaggaccacugguucucccgggagaacagcuacuccggcguggagggggagggccugcacaagcucggguacauccugcgcgacaucagcaagauccccggcggcgcgauguacgccgacgacaccgccgggugggacacccggaucacggaggacgaccugcacaacgaggagaagaucacccagcagauggacccggagcaccgccuccuggccaacgccaucuucaagcugaccuaccagaacaaggucgugaaggugcagcggcccacccccaccggcacggucauggacaucaucucccgcaaggaccagcgggggagcggccaggugggcaccuacgggcucaacaccuucaccaacauggaggcgcagcugauccgccagauggagggcgagggggugcuguccaaggccgaccucgagaacccccaccugagcgagaagaaggucacgcaguggcuggagaccaagggcguggagcggcucaagcgcauggccaucuccggggacgacugcguggucaagccgaucgacgaccgguucgccaacgcccugcuggcgcucaacgacaugggcaaggugcgcaaggacaucccccaguggcagcccagcaagggcuggcacgacuggcagcagguccccuucugcucccaccacuuccacgagcugaucaugaaggacgggcggaagcuggucgugccgugccgcccccaggacgagcucaucggccgggcccgcaucagccagggggccggcuggucccugcgggagaccgccugccuggggaaggcguacgcccagauguggagccucauguacuuccaccgccgcgaccugcggcuggccuccaacgccaucugcagcgccgugcccguccacugggugcccaccucccgcacgaccuggagcauccacgcgcaccaccaguggaugaccaccgaggacaugcucacgguguggaaccgggucuggaucgaggacaacccguggauggaggacaagacccccgugaccaccugggagaacgugcccuaccugggcaagcgcgaggaccaguggugcggcagccugaucgggcucacgucccgggccaccugggcccagaacauccccaccgccauccagcagguccgcagccugaucggcaacgaggaguuccuggacuacaugccguccaugaagcgguuccgcaaggaggaggagagcgagggggccaucugguga

SEQ ID NO: 9918 - RNA, 9873 nt, Artificial Sequence
  derived and/or modified CDS sequence (opt1) from DENV-3__GQ868577__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagaucguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucguccgggaggcgaucaagcgccggcuccgcacccugauccuggcccccacccgggugguggccgccgagauggaggaggcccucaaggggcugcccauccgcuaccagaccacggcgaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggguacaucagcacccgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcguacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcgggugcccacccaccucgcccaccgcacccggaacgcccuggacaaccuggucaugcuccacacguccgagcacggcgggaaggccuaccgccacgcgguggaggagcugcccgagaccauggagacccugcuccugcugggccucaugauccugcugaccgggggcgccaugcuguuccugaucagcggcaaggggaucggcaagacgagcaucgggcugaucugcgugaucgccuccagcggcaugcucuggauggccgagaucccgcugcaguggaucgccuccgcgaucguccuggaguucuucaugauggugcuccugauccccgagcccgagaagcagcggacgccccaggacaaccagcuggccuacguggucaucgggauccucacccuggccgccaucaucgccgcgaacgagaugggccugcucgagaccacgaagcgcgaccugggcaugagcaaggagccggggguggugucccccaccagcuaccuggacgucgaccuccaccccgccuccgccuggacccuguacgccguggcgaccacggugaucacccccaugcugcggcacaccaucgagaacagcaccgccaacgucucccucgccgccaucgccaaccaggcgguggugcugaugggccuggacaagggguggccgaucagcaagauggaccucggcgucccccugcuggcccucgggugcuacucccaggugaacccccugacgcugaccgccgccgugcuccugcugaucacccacuacgccaucaucggccccggccuccaggcgaaggccacccgcgaggcccagaagcggacggccgccgggaucaugaagaacccgaccgucgacggcaucaugaccaucgaccuggaccccgugaucuacgacagcaaguucgagaagcagcugggccaggugaugcuccugguccugugcgcggugcagcuccugcugaugcgcaccuccugggcccucugcgaggcccugacgcuggccaccggccccaucaccacccucugggagggcagccccgggaaguucuggaacacgaccaucgcgguguccauggccaacaucuuccggggcagcuaccuggccggggccggccuggccuucuccaucaugaaguccgucgggaccggcaagcgcggcaccgggucccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgugucccgcggcagcgccaagcugcagugguucgucgagcggaacauggugaucccggaggggcgcgugaucgaccucggcugcgggcggggcgggugguccuacuacugcgccggccugaagaaggucaccgaggugcgcggcuacacgaagggcgggcccgggcacgaggagcccgugcccaugagcaccuacggcuggaacaucgucaagcugauguccgggaaggacguguucuaccucccgcccgagaagugcgacacccugcugugcgacaucggcgagagcucccccagccccaccguggaggagucccggacgauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugagccggaacuccacccacgagauguacuggaucagcaacggcaccgggaacaucguggccuccgucaacauggugagccgccuccugcugaaccgguucacgaugacccaccgccggccgaccaucgagaaggacguggaccucggcgcgggcacccgccacgucaacgccgagcccgagacgcccaacauggacgugaucggggagcggaucaagcgcaucaaggaggagcacaacuccaccuggcacuacgacgacgagaacccguacaagaccugggccuaccacggcagcuacgaggugaaggccaccggguccgccagcuccaugaucaacggcgucgugaagcugcugacgaagcccugggacgucgugcccauggugacccagauggcgaugaccgacaccacgcccuucgggcagcagcgggucuucaaggagaagguggacacccgcaccccgcggagcaugcccggcacccgccgggugaugggcaucacggccgaguggcucuggcgcacccuggggcggaacaagaagccccgccugugcacccgggaggaguucaccaagaagguccgcacgaacgccgccaugggcgcgguguucaccgaggagaaccagugggacagcgccaaggccgccguggaggacgaggacuucuggaagcucgucgaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaaggucgugaaggugcagcggcccacccccaccggcacggucauggacaucaucucccgcaaggaccagcggggcagcggccaggugggcaccuacgggcugaacaccuucaccaacauggaggcccagcucauccgccagauggagggcgagggggugcuguccaaggccgaccuggagaacccccaccucccggagaagaagaucgcgcaguggcuggagacgaagggcgucgagcggcugaagcgcauggccaucagcggcgacgacugcguggugaagcccaucgacgaccgguucgccaacgcccuccuggcccugaacgacauggggaagguccgcaaggacaucccccaguggcagcccuccaagggcuggcacgacuggcagcaggucccguucugcagccaccacuuccacgagcucaucaugaaggacgggcggaagcuggugguccccugccgcccccaggacgagcugaucggccgggcgcgcaucucccagggggccggcuggagccuccgggagaccgccugccugggcaaggccuacgcgcagauguggucccugauguacuuccaccgccgcgaccuccggcuggccagcaacgccaucugcuccgccgugcccgugcacugggucccgaccagccgcaccacgugguccauccacgcccaccaccaguggaugaccaccgaggacaugcugaccguguggaaccggguguggaucgaggacaaccccuggauggagaacaagacgcccgucaccaccugggagaacgugcccuaccucgggaagcgcgaggaccaguggugcggcagccugaucgggcugaccagccgggcgacgugggcccagaacaucccgaccgccauccagcagguccgcucccucaucggcaacgaggaguuccuggacuacaugcccagcaugaagcgguuccgcaaggaggaggaguccgagggggccaucugguga

SEQ ID NO: 9919 - RNA, 9873 nt, Artificial Sequence
  derived and/or modified CDS sequence (opt1) from DENV-3__GU131954__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcguacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccacccaccucgcccaccgcacccggaacgcccuggacaaccuggugaugcuccacacguccgagcacggcgggaaggccuaccgccacgcgguggaggagcugcccgagaccauggagacccugcuccugcugggccucaugauccugcugaccgggggcgucaugcuguuccugaucagcggcaaggggaucggcaagacgagcaucgggcugaucugcgugaucgccuccagcggcaugcucuggauggccgagaucccgcugcaguggaucgccuccgccaucgugcuggaguucuucaugaugguccuccugauccccgagcccgagaagcagcggacgccccaggacaaccagcuggcguacguggugaucgggauccucacccuggccgccaucaucgccgccaacgagaugggccugcucgagaccacgaagcgcgaccugggcaugaccaaggagccgggggcggucagccccaccuccuaccuggacguggaccuccaccccgccagcgccuggacccuguacgccguggcgacgaccgucaucacccccaugcugcggcacaccaucgagaacuccacggccaacgugagccucgccgccaucgccaaccaggcggugguccugaugggccuggacaagggguggccgaucuccaagauggaccucggcgugccccugcuggcccucgggugcuacagccaggugaacccccugacccugaccgccgccguccuccugcugaucacccacuacgccaucaucggccccggccuccaggcgaaggccacgcgcgaggcccagaagcggaccgccgccgggaucaugaagaacccgaccguggacggcaucaugaccaucgaccuggaccccgugaucuacgacuccaaguucgagaagcagcuggggcaggucaugcuccuggugcugugcgcggugcagcuccugcugaugcgcacgagcugggcccucugcgaggcccugacccuggccaccggccccaucaccacgcucugggagggcucccccgggaaguucuggaacaccaccaucgcggucagcauggccaacaucuuccggggcuccuaccuggccggggccggccuggccuucagcaucaugaaguccguggggaccggcaagcgcggcaccgggagccagggcgagacgcucggggagaaguggaagaagaagcugaaccagcugucccggaaggaguucgaccucuacaagaaguccggcaucaccgagguggaccgcaccgaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugacggaggugcgcggcuacaccaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccacggucgaggagagccggaccauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacccacgagauguacuggaucuccaacggcacggggaacaucgucgccagcgugaacauggugucccgccuccugcugaaccgguucaccaugacccaccgccggccgaccaucgagaaggacgucgaccucggcgcgggcacgcgccacgugaacgccgagcccgagacccccaacauggacgugaucggggagcggaucaagcgcaucaaggaggagcacaacagcaccuggcacuacgacgacgagaacccguacaagaccugggccuaccacggcuccuacgaggucaaggccacggggagcgccuccagcaugaucaacggcguggucaagcugcugaccaagcccugggacguggugcccauggucacccagauggcgaugaccgacacgacccccuucgggcagcagcggguguucaaggagaagguggacacccgcaccccgcgguccaugcccggcacgcgccgggucaugggcaucaccgccgaguggcucuggcgcacccuggggcggaacaagaagccccgccugugcacccgggaggaguucacgaagaaggugcgcaccaacgccgccaugggcgcgguguucaccgaggagaaccagugggacagcgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacgcggaucaccgaggacgaccugcacaacgaggagaagaucacccagcagauggacccggagcaccgccagcucgccaacgccaucuucaagcugaccuaccagaacaagguggugaagguccagcggcccacccccacgggcaccgugauggacaucaucagccgcaaggaccagcggggcuccggccaggugggcaccuacgggcugaacaccuucacgaacauggaggcccagcucauccgccagauggagggcgaggggguccugagcaaggccgaccuggagaacccccaccucccggagaagaaggugacccaguggcuggagaccaagggcguggagcggcugaagcgcauggcgaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccguccccgugcacugggugccgacgucccgcaccaccuggagcauccacgcccaccaccaguggaugaccacggaggacaugcugaccgucuggaaccggguguggaucgaggacaaccccuggauggaggacaagacccccgugaccacgugggagaacguccccuaccucgggaagcgcgaggaccaguggugcggcucccugaucgggcugaccagccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 9920 - RNA, 9873 nt, Artificial Sequence
  derived and/or modified CDS sequence (opt1) from DENV-3__GQ868578__SS-prME
accagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagagcaucgagggcaaggucgugcaguacgagaaccucaaguacaccgugaucaucacgguccacaccggggaccagcaccaggugggcaacgagacccagggggucaccgccgagaucacgccccaggccuccaccaccgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaaccgcaaggagcuccuggugaccuucaagaacgcccacgccaagaagcaggaggucguggugcuggggagccaggagggcgcgaugcacaccgcccucacgggggccaccgagauccagaacuccggcgggaccagcaucuucgccggccaccugaagugccggcugaagauggacaagcucgagcugaagggcauguccuacgccaugugcaccaacacguucguccugaagaaggaggugagcgagacccagcacgggaccauccucaucaagguggaguacaagggcgaggacguccccugcaagaucccguucagcaccgaggacgggcagggcaaggcgcacaacggccgccugaucacggccaaccccguggugaccaagaaggaggagcccgucaacaucgaggccgagcccccguucggggaguccaacaucgugaucggcaucggggacaacgcccugaagaucaacugguacaagaagggcagcuccaucgggaagauguucgaggcgaccgcccggggcgcccgccggauggccauccugggcgacaccgccugggacuucgggagcgugggcgggguccucaacucccugggcaagauggugcaccagaucuucgggagcgcguacacggcccuguucuccggcgugagcugggucaugaagaucggcaucggggugcuccugaccuggaucggccugaacuccaagaacaccagcauguccuucagcugcaucgccaucgggaucaucacccucuaccugggcgccgugguccaggccgacauggggugcgugaucaacuggaagggcaaggagcugaagugcggcuccgggaucuucgugacgaacgagguccacaccuggaccgagcaguacaaguuccaggcggacagccccaagcgccucgccaccgccaucgccggcgccugggagaacggggugugcggcauccgcuccacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagcccauggagcugaaguacagcuggaagaccugggggaaggccaagaucgucaccgccgagacccagaacuccagcuucaucaucgacggcccgaacacgcccgagugccccuccgccagccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagucccagaagaacgggagcuggaagcuggagaaggcgucccugaucgaggugaagaccugcaaguggcccaagagccacacgcucugguccaacggcgugcuggagagcgacaugaucaucccgaagucccuggccgggcccaucagccagcacaacuaccggcccggcuaccacacccagaccgccgggccguggcaccucggcaagcuggagcuggacuucaacuacugcgagggcaccacggucgugaucaccgagaacugcgggacccgcggccccucccuccggaccacgaccgugagcgggaagcugauccacgaguggugcugccgcuccugcacccugcccccccuccgguacaugggcgaggacgggugcugguacggcauggagauccgcccgaccagcgagaaggaggagaacauggucaagucccuggugagcgccggcuccggggagguggacaacuucacgaugggcguccugugccucgccauccuguucgaggaggugaugcgggggaaguucggcaagaagcacaugaucgcgggggugcuguucaccuucguccuccugcugagcggccagaucaccuggcgcgacauggcccacacccucaucaugaucggcuccaacgccagcgaccggauggggaugggcgugacguaccuggcccugaucgccaccuucaagauccagcccuuccucgcgcugggguucuuccugcgcaagcucaccagccgggagaaccugcugcucggcgugggccuggccauggccaccacgcugcagcuccccgaggacaucgagcagauggccaacgggaucgcgcugggccugauggcccucaagcugaucacccaguucgagaccuaccagcuguggaccgcccucaucucccugacgugcagcaacaccaucuucacccugaccgucgccuggcgcacggccacccucauccuggcgggggugucccugcuccccgucugccagagcuccagcaugcggaagaccgacuggcugccgaugaccguggccgccaugggcgugcccccccugccccucuucaucuucucccugaaggacacgcugaagcgccgcagcuggccgcucaacgagggggucauggccgugggccugguguccauccuggccagcucccuccugcggaacgacguccccauggcgggcccccugguggccgggggccuccugaucgccugcuacgugaucaccgggaccagcgccgaccugaccgucgagaaggccgcggacgugacgugggaggaggaggccgagcagaccggcgugucccacaaccucaugaucaccgucgacgacgacgggaccaugcgcaucaaggacgacgagaccgagaacauccugacggugcugcucaagaccgcccugcugaucgugagcggcaucuuccccuacuccaucccggccacccuccuggucuggcacaccuggcagaagcagacgcagcggagcggcgugcugugggacgugcccuccccccccgagacccagaaggccgagcucgaggagggggucuaccgcaucaagcagcagggcaucuucgggaagacccaggugggcguggggguccagaaggagggcguguuccacaccauguggcacgugacgcggggcgcgguccugaccuacaacgggaagcgccuggagccgaacugggccagcgugaagaaggaccucaucuccuacggcgggggcuggcggcugagcgcccaguggcagaagggggaggaggugcaggucaucgccguggagcccggcaagaaccccaagaacuuccagaccaugcccggcaccuuccagacgaccaccggggagaucggcgcgaucgcccuggacuucaagccggggaccagcggcucccccaucaucaaccgcgagggcaagaucguggggcuguacggcaacggggucgugacgaagaacggcggguacgugagcggcaucgcccagaccaacgccgagcccgacggcccgacccccgagcucgaggaggagauguucaagaagcggaaccugaccaucauggaccugcaccccggguccggcaagacgcgcaaguaccuccccgccaucguccgggaggcgaucaagcgccggcugcgcacccugauccucgccccgacccgggugguggccgccgagauggaggaggcccugaaggggcugcccauccgcuaccagaccacggcgaccaagagcgagcacaccggccgggagaucgucgaccucaugugccacgccaccuucacgaugcgccugcugucccccgugcgggugcccaacuacaaccucaucaucauggacgaggcccacuucaccgacccggccagcaucgccgcgcgcggguacaucuccacccgggucggcaugggcgaggccgccgccaucuucaugaccgcgacgccccccgggaccgccgacgccuucccccagagcaacgccccgauccaggacgaggagcgcgacauccccgagcgcuccuggaacagcggcaacgaguggaucaccgacuucgccgggaagaccgugugguucgugcccuccaucaaggcgggcaacgacaucgccaacugccugcggaagaacgggaagaaggucauccagcugagccgcaagacguucgacaccgaguaccagaagaccaagcucaacgacugggacuucguggugaccacggacaucuccgagaugggcgccaacuucaaggccgaccgggucaucgacccccgccggugccugaagccggugauccugaccgacggccccgagcgcgugauccucgccgggcccaugcccgucaccgcggccagcgccgcccagcggcgcggccggguggggcgcaacccgcagaaggagaacgaccaguacaucuucaccggccagccccugaacaacgacgaggaccacgcccacuggaccgaggcgaagaugcugcucgacaacaucaacacgcccgaggggaucauccccgcccuguucgagccggagcgggagaaguccgccgccaucgacggcgaguaccgccugaagggcgagagccggaagaccuucguggagcucaugcgccggggggaccugcccgucuggcuggcguacaagguggccuccgagggcaucaaguacaccgaccgcaaguggugcuucgacgggcagcggaacaaccagauccucgaggagaacauggacgucgagaucuggaccaaggagggcgagaagaagaagcugcgcccccgguggcuggacgcccgcacguacagcgacccccucgcccugaaggaguucaaggacuucgccgcgggccgcaaguccaucgcccuggaccucgugaccgagaucgggcgggugccgacccaccuggcccaccgcacccggaacgcccuggacaaccucgucaugcugcacacgagcgagcacggcgggaaggccuaccgccacgcgguggaggagcugcccgagaccauggagacccuccugcugcucggccugaugauccugcucaccgggggcgccaugcuguuccugaucagcggcaaggggaucggcaagacguccaucgggcucaucugcgugaucgccagcuccggcaugcuguggauggccgagaucccccugcaguggaucgccagcgcgaucguccucgaguucuucaugauggugcugcugaucccggagcccgagaagcagcggaccccccaggacaaccagcucgccuacguggucaucgggauccugacccuggccgccaucaucgccgcgaacgagaugggccuccuggagaccacgaagcgcgaccugggcauguccaaggagcccgggguggugagcccgaccuccuaccucgacgucgaccugcaccccgccagcgccuggacccuguacgccguggcgaccacggugaucacccccaugcuccggcacaccaucgagaacuccaccgccaacgucagccuggccgccaucgccaaccaggcgguggugcugaugggccucgacaagggguggcccaucuccaagauggaccugggcgucccgcugcucgcccuggggugcuacagccaggugaacccccugacgcucaccgccgccgugcugcugcucaucacccacuacgccaucaucggccccggccugcaggcgaaggccacccgcgaggcccagaagcggacggccgccgggaucaugaagaaccccaccgucgacggcaucaugaccaucgaccuggacccggugaucuacgacuccaaguucgagaagcagcucgggcaggugaugcugcugguccucugcgcggugcagcugcugcucaugcgcaccagcugggcccugugcgaggcccugacgcucgccaccggccccaucaccacccugugggagggcucccccgggaaguucuggaacacgaccaucgcggugagcauggccaacaucuuccggggcuccuaccuggccggggccggccucgccuucagcaucaugaaguccgucgggaccggcaagcgcggcaccgggagccagggcgagacccugggggagaaguggaagaagaagcugaaccagcucagccggaaggaguucgaccuguacaagaaguccggcaucacggagguggaccgcaccgaggcgaaggaggggcugaagcggggcgagaucacccaccacgccgugagccgcggcuccgccaagcuccagugguucgucgagcggaacauggugauccccgaggggcgcgugaucgaccugggcugcgggcggggcggguggagcuacuacugcgccggccugaagaaggucaccgaggugcgcggcuacacgaaggggggcccggggcacgaggagcccgugcccauguccaccuacggcuggaacaucgucaagcucaugagcgggaaggacguguucuaccugcccccggagaagugcgacacccugcugugcgacaucggcgaguccagccccucccccaccguggaggagagccggacgauccgcguccucaagaugguggagcccuggcugaagaacaaccaguucugcaucaaggugcugaacccguacaugcccaccgucaucgagcaccucgagcgccugcagcggaagcacggcgggaugcuggugcgcaacccccucucccggaacagcacccacgagauguacuggaucuccaacggcaccgggaacaucguggccagcgucaacauggugucccgccugcugcucaaccgguucacgaugacccaccgccggcccaccaucgagaaggacguggaccugggcgcgggcacccgccacgucaacgccgagccggagacgcccaacauggacgugaucggggagcggaucaagcgcaucaaggaggagcacaacagcaccuggcacuacgacgacgagaaccccuacaagaccugggccuaccacggcuccuacgaggugaaggccaccgggagcgccuccagcaugaucaacggcgucgugaagcugcucacgaagccgugggacgucgugcccauggugacccagauggcgaugaccgacaccacgcccuucgggcagcagcgggucuucaaggagaagguggacacccgcaccccccggagcaugccgggcacccgccgggugaugggcaucacggccgaguggcuguggcgcacccuggggcggaacaagaagccccgccucugcacccgggaggaguucaccaagaagguccgcacgaacgccgccaugggcgcgguguucaccgaggagaaccagugggacuccgccaaggccgccguggaggacgaggacuucuggaagcuggucgaccgcgagcgggagcugcacaagcucgggaagugcggcagcugcguguacaacaugauggggaagcgcgagaagaagcugggcgaguucggcaaggccaaggggucccgggcgaucugguacauguggcugggcgcccgcuaccucgaguucgaggcccugggguuccugaacgaggaccacugguucagccgggagaacuccuacagcggcguggagggggagggccuccacaagcugggcuacauccugcgcgacaucuccaagauccccgggggcgccauguacgccgacgacaccgcggggugggacacccggaucacggaggacgaccuccacaacgaggagaagaucacccagcagauggaccccgagcaccgccagcuggccaacgccaucuucaagcugaccuaccagaacaaggucgugaaggugcagcggccgacccccaccggcacggucauggacaucaucagccgcaaggaccagcggggcuccgggcaggugggcaccuacgggcucaacaccuucaccaacauggaggcccagcugauccgccagauggagggcgagggggugcugagcaaggccgaccucgagaacccccaccugcccgagaagaagaucgcgcaguggcuggagacgaagggcgucgagcggcucaagcgcauggccaucuccggcgacgacugcguggugaagccgaucgacgaccgguucgccaacgcccugcuggcccucaacgacauggggaagguccgcaaggacaucccccaguggcagcccagcaagggcuggcacgacuggcagcaggugcccuucugcucccaccacuuccacgagcugaucaugaaggacgggcggaagcugguggucccgugccgcccccaggacgagcucaucggccgggcgcgcaucagccagggggccggcuggucccugcgggagaccgccugccugggcaaggccuacgcgcagauguggagccucauguacuuccaccgccgcgaccugcggcuggccuccaacgccaucugcagcgccgugcccgugcacuggguccccaccucccgcaccacguggagcauccacgcccaccaccaguggaugaccaccgaggacaugcucaccguguggaaccggguguggaucgaggacaacccguggauggaggacaagacgcccgucaccaccugggagaacgugcccuaccuggggaagcgcgaggaccaguggugcggcagccugaucgggcucaccucccgggcgacgugggcccagaacauccccaccgccauccagcaggugcgcagccugaugggcaacgaggaguuccuggacuacaugccguccaugaagcgguuccgcaaggaggaggagagcgagggggccaucugguga

SEQ ID NO: 9921 - RNA, 9873 nt, Artificial Sequence
  derived and/or modified CDS sequence (opt1) from DENV-3__FJ898457__SS-prME
accagccugugccucaugaugauccugcccgccgcccuggcguuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcagcacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccuggaucaugaagaucggcaucggggugcuccugaccuggaucggccugaacagcaagaacaccuccaugagcuucuccugcaucgccaucgggaucaucacccucuaccugggcgccgucgugcaggcggacauggggugcgugaucaacuggaagggcaaggagcugaagugcggcagcgggaucuucgucacgaacgaggugcacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgugugggaggucgaggacuacggguucggcguguucaccaccaacaucuggcucaagcugcgcgagguguacacccagcugugcgaccaccggcucaugagcgccgccgucaaggacgagcgcgccgugcacgcggacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgcgauccuguucgaggaggugaugcgggggaaguucggcaagaagcacaugaucgccggggucuucuucaccuucgugcugcuccuguccggccagaucaccuggcgcgacauggcccacacccugaucaugaucggcagcaacgccuccgaccggauggggaugggcgugacguaccucgcccugaucgcgaccuucaagauccagcccuuccuggcccucggguucuuccugcgcaagcugaccagccgggagaaccuccugcugggcgucggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccguggccuggcgcacggcgacccugauccucgccggggugagccugcugccggucugccaguccagcuccaugcggaagaccgacuggcuccccauggccguggccgccaugggcgugccgccccucccgcuguucaucuucagccucaaggacacccugaagcgccgcuccuggccccugaacgagggggugauggcggugggccucgucagcauccuggccuccagccugcuccggaacgacgugcccauggccggcccccugguggccgggggccugcucaucgccugcuacgucaucacggggaccuccgcggaccugaccguggagaaggccgccgacaucaccugggaggaggaggccgagcagacgggcgugagccacaaccugaugaucaccgucgacgacgacgggaccaugcgcaucaaggacgacgagaccgagaacauccucaccgugcugcugaagacggcccuccugaucguguccggcaucuucccguacagcauccccgcgacccugcucgucuggcacaccuggcagaagcagacccagcgguccggcgugcugugggacgugcccagcccgcccgagacgcagaaggccgagcuggaggagggggucuaccgcaucaagcagcagggcaucuucgggaagacccaggugggcguggggguccagaaggagggcguguuccacaccauguggcacgugacccggggcgccguccucacguacaacgggaagcgccuggagcccaacugggccuccgugaagaaggaccugaucagcuacggcgggggcuggcggcucuccgcgcaguggcagaagggggaggaggugcaggucaucgccguggagcccggcaagaaccccaagaacuuccagaccaugcccggcaccuuccagaccacgaccggggagaucggcgccaucgcccuggacuucaagcccgggaccagcggcagccccaucaucaaccgcgagggcaagguggucgggcuguacggcaacgggguggugaccaagaacggcggguacgucuccggcaucgcccagacgaacgcggagccggacggccccacccccgagcuggaggaggagauguucaagaagcggaaccucaccaucauggaccugcaccccgggagcggcaagacccgcaaguaccugccggccaucgugcgggaggccaucaagcgccggcuccgcacgcugauccuggcccccacccggguggucgccgcggagauggaggaggcccucaaggggcugcccauccgcuaccagaccaccgccacgaaguccgagcacaccggccgggagaucguggaccugaugugccacgccaccuucaccaugcgccuccugagccccgugcgggucccgaacuacaaccugaucaucauggacgaggcccacuucacggaccccgcguccaucgccgcccgcggguacaucagcacccgggugggcaugggcgaggccgcggccaucuucaugaccgccacgccgcccgggacggccgacgccuucccgcaguccaacgcgcccauccaggacgaggagcgcgacauccccgagcgcagcuggaacuccggcaacgaguggaucaccgacuucgccgggaagaccgugugguucguccccagcaucaaggccggcaacgacaucgccaacugccuccggaagaacgggaagaaggugauccagcugucccgcaagaccuucgacacggaguaccagaagaccaagcugaacgacugggacuucguggucaccaccgacaucagcgagaugggcgccaacuucaaggcggaccgggugaucgacccgcgccggugccucaagcccgugauccugacggacggccccgagcgcgucauccuggccgggcccaugccggugaccgccgccuccgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagucccggaagacguucgucgagcugaugcgccgcggggaccuccccguguggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcgcucaaggaguucaaggacuucgccgccggccgcaagagcaucgcccuggaccuggugacggagaucgggcggguccccucccaccucgcccaccgcacccggaacgcgcuggacaaccuggugaugcuccacaccagcgagcacggcgggcgcgccuaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgucaucgccagcuccggcaugcucuggauggcggagaucccgcugcaguggaucgccagcgccaucgugcuggaguucuucaugauggugcuccugauccccgagcccgagaagcagcgcacgccccaggacaaccagcuggccuacgucgugaucgggauccucacgcuggccgcgaucaucgccgccaacgagaugggccugcucgagaccaccaagcgggaccugggcauguccaaggagccggggguggucagccccaccuccuaccuggacguggaccuccaccccgccagcgcguggacgcuguacgccguggccaccaccgucaucacccccaugcugcgccacacgaucgagaacuccaccgccaacgugagccucgccgcgaucgccaaccaggccgugguccugaugggccuggacaagggguggccgaucuccaagauggaccucggcgugccccugcuggcccucgggugcuacagccaggugaacccccugacccugaccgccgcgguccuccugcugaucacgcacuacgccaucaucggccccggccuccaggccaaggccacccgggaggcccagaagcgcaccgcggccgggaucaugaagaacccgaccguggacggcaucaugacgaucgaccuggaccccgugaucuacgacuccaaguucgagaagcagcuggggcaggucaugcuccuggugcugugcgccgugcagcuccugcugaugcggaccagcugggcccucugcgaggcgcugacccuggccaccggccccaucacgacccucugggagggcucccccgggaaguucuggaacaccaccaucgccgucagcauggccaacaucuuccgcggcuccuaccuggccggggcgggccuggccuucagcaucaugaagacgguggggaccggcaagcggggcaccgggucccagggcgagacccucggggagaaguggaagaagaagcugaaccagcugagccgcaaggaguucgaccucuacaagaaguccggcaucaccgagguggaccggacggaggccaaggaggggcugaagcgcggcgagaucacccaccacgccgucucccggggcagcgccaagcugcagugguucguggagcgcaacauggugaucccggaggggcgggucaucgaccucggcugcgggcgcggcgggugguccuacuacugcgcgggccugaagaaggugaccgaggugcggggcuacaccaagggcgggcccgggcacgaggagcccguccccaugagcacguacggcuggaacaucgugaagcugauguccgggaaggacguguucuaccucccgcccgagaagugcgacacccugcugugcgacaucggcgagagcucccccagccccaccgucgaggagucccgcaccauccgcgugcugaagaugguggagccguggcucaagaacaaccaguucugcaucaagguccugaaccccuacaugcccacggugaucgagcaccuggagcggcuccagcgcaagcacggcgggaugcuggugcggaacccccugagccgcaacuccacccacgagauguacuggaucagcaacggcaccgggaacaucgucgccuccgugaacauggugagccggcuccugcugaaccgcuucaccaugacgcaccggcgcccgaccaucgagaaggacgucgaccucggcgccggcacccggcacgugaacgccgagcccgagacccccaacauggacgugaucggggagcgcaucaagcggaucaaggaggagcacaacuccacguggcacuacgacgacgagaacccguacaagaccugggccuaccacggcagcuacgaggucaaggcgaccggguccgccagcuccaugaucaacggcguggugaagcugcugaccaagcccugggacgucgugcccauggucacgcagauggccaugaccgacaccacccccuucgggcagcagcgcguguucaaggagaagguggacacgcggaccccgcgcagcaugcccggcacccggcgcgucaugggcaucaccgccgaguggcucuggcggacgcuggggcgcaacaagaagccccggcugugcacccgcgaggaguucaccaagaaggugcgcaccaacgcggccaugggcgccguguucacggaggagaaccagugggacagcgccaaggccgcggucgaggacgaggacuucuggaagcucguggaccgggagcgcgagcugcacaagcuggggaagugcggcuccugcguguacaacaugauggggaagcgggagaagaagcucggcgaguucggcaaggccaaggggagccgcgccaucugguacauguggcugggcgcccgguaccuggaguucgaggcccucggguuccugaacgaggaccacugguucucccgcgagaacagcuacuccggcgucgagggggagggccugcacaagcucggcuacauccugcgggacaucagcaagauccccgggggcgcgauguacgccgacgacaccgccgggugggacacccgcaucaccgaggacgaccugcacaacgaggagaagaucacgcagcagauggacccggagcaccggcagcucgccaacgccaucuucaagcugaccuaccagaacaagguggugaagguccagcgccccacccccaccggcaccgugauggacaucaucucccggaaggaccagcgcggcagcggccaggugggcacguacgggcugaacaccuucaccaacauggaggcgcagcucauccggcagauggagggcgaggggguccuguccaaggccgaccuggagaacccccaccucccggagaagaagaucacccaguggcuggagacgaagggcguggagcgccugaagcggauggccaucagcggcgacgacugcguggucaagcccaucgacgaccgcuucgccaacgcccuccuggcgcugaacgacauggggaaggugcggaaggacaucccccaguggcagcccuccaagggcuggcacgacuggcagcaggucccguucugcagccaccacuuccacgagcucaucaugaaggacgggcgcaagcuggucgugcccugccggccccaggacgagcugaucggccgcgcccggaucucccagggggccggcuggagccuccgcgagaccgccugccugggcaaggcguacgcccagauguggucccugauguacuuccaccgccgggaccuccgccuggccagcaacgccaucugcuccgccgugcccguccacugggugccgaccagccggaccacgugguccauccacgcgcaccaccaguggaugaccaccgaggacaugcugaccguguggaaccgcgucuggaucgaggacaaccccuggauggaggacaagacgcccgugaccaccugggagaacgugcccuaccucgggaagcgggaggaccaguggugcggcagccugaucgggcugaccagccgcgccacgugggcccagaacaucccgaccgccauccagcagguccggucccucaucggcaacgaggaguuccuggacuacaugcccagcaugaagcgcuuccggaaggaggaggaguccgagggggccaucugguga

SEQ ID NO: 9922 - RNA, 9873 nt, Artificial Sequence
  derived and/or modified CDS sequence (opt1) from DENV-3__KF955505__SS-prME
accagccugugccucaugaugauccugcccgccgcccuggcguuccaccucaccagccggaacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgugacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccauguucacccugaccguggccuggcgcacggcgacccugauccucgccggggucagccugcugccggugugccaguccagcuccaugcggaagaccgacuggcuccccauggccgucgccgccaugggcgugccgccccucccgcuguucaucuucagccucaaggacacccugaagcgccgcuccuggccccugaacgagggggugauggcggucggccucgugagcauccuggccuccagccugcuccggaacgacgugcccauggccggcccccuggucgccgggggccugcucaucgccugcuacgugaucacggggaccuccgcggaccugaccguggagaaggccgccgacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcguguucccguacagcauccccgcgacccugcucguguggcacaccuggcagaagcagacccagcgguccggcguccugugggacgugcccagcccgcccgagacgcagaaggccgagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccuccgucaagaaggaccugaucagcuacggcgggggcuggcggcucuccgcgcaguggcagaagggggaggagguccaggugaucgccgucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgcggagccggacggccccacccccgagcuggaggaggagauguucaagaagcggaaccucaccaucauggaccugcaccccgggagcggcaagacccgcaaguaccugccggccaucguccgggaggccaucaagcgccggcuccgcacgcugauccuggcccccacccgggugguggccgcggagauggaggaggcccucaaggggcugcccauccgcuaccagaccaccgccacgaaguccgagcacaccggccgggagaucgucgaccugaugugccacgccaccuucaccaugcgccuccugagccccgugcgggugccgaacuacaaccugaucaucauggacgaggcccacuucacggaccccgcguccaucgccgcccgcggguacaucagcacccgggucggcaugggcgaggccgcggccaucuucaugaccgccacgccgcccgggacggccgacgccuucccgcaguccaacgcgcccauccaggacgaggagcgcgacauccccgagcgcagcuggaacuccggcaacgaguggaucaccgacuucgccgggaagaccgugugguucgugcccagcaucaaggccggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggcggaccgggucaucgacccgcgccggugccucaagcccgugauccugacggacggccccgagcgcgugauccuggccgggcccaugccggucaccgccgccuccgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagucccggaagacguucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcgcucaaggaguucaaggacuucgccgccggccgcaagagcaucgcccuggaccuggugacggagaucgggcgggugcccucccaccucgcccaccgcacccggaacgcgcuggacaaccuggucaugcuccacaccagcgagcacggcgggcgcgccuaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucguccuggaguucuucaugauggugcuccugauccccgagcccgagaagcagcgcacgccccaggacaaccagcuggccuacguggucaucgggauccucacgcuggccgcgaucaucgccgccaacgagaugggccugcucgagaccaccaagcgggaccugggcauguccaaggagccggggguggugagccccaccuccuaccuggacgucgaccuccaccccgccagcgcguggacgcuguacgccguggccaccaccgugaucacccccaugcugcgccacacgaucgagaacuccaccgccaacgucagccucgccgcgaucgccaaccaggccguggugcugaugggccuggacaagggguggccgaucuccaagauggaccucggcgucccccugcuggcccucgggugcuacagccaggugaacccccugacccugaccgccgcggugcuccugcugaucacgcacuacgccaucaucggccccggccuccaggccaaggccacccgggaggcccagaagcgcaccgcggccgggaucaugaagaacccgaccgucgacggcaucaugacgaucgaccuggaccccgugaucuacgacuccaaguucgagaagcagcugggccaggugaugcuccugguccugugcgccgugcagcuccugcugaugcggaccagcugggcccucugcgaggcgcugacccuggccaccggccccaucacgacccucugggagggcucccccgggaaguucuggaacaccaccaucgccgugagcauggccaacaucuuccgcggcuccuaccuggccggggcgggccuggccuucagcaucaugaaguccgucgggacgggcaagcggggcaccgggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagacgacccaccacgccgugagccggggcuccgccaagcugcagugguucgucgagcgcaacauggugaucccggaggggcgggugaucgaccucggcugcgggcgcggcggguggagcuacuacugcgcgggccugaagaaggucaccgaggugcggggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccgcaccauccgcguccugaagaugguggagccguggcucaagaacaaccaguucugcaucaaggugcugaaccccuacaugcccacggucaucgagcaccuggagcggcuccagcgcaagcacggcgggaugcuggugcggaacccccugucccgcaacagcacccacgagauguacuggaucuccaacggcaccgggaacaucguggccagcgucaacauggugucccggcuccugcugaaccgcuucaccaugacgcaccggcgcccgaccaucgagaaggacguggaccucggcgccggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggcgaccgggagcgccuccagcaugaucaacggcgucgugaagcugcugaccaagcccugggacgucgugcccauggugacgcagauggccaugaccgacaccacccccuucgggcagcagcgcgucuucaaggagaagguggacacgcggaccccgcgcagcaugcccggcacccggcgcgugaugggcaucaccgccgaguggcucuggcggacgcuggggcgcaacaagaagccccggcugugcccccgcgaggaguucaccaagaagguccgcaccaacgcggccaugggcgccguguucaccgaggagaaccagugggacuccgccaaggccgcgguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgccaucugguacauguggcugggcgcccgguaccuggaguucgaggcccucggguuccugaacgaggaccacugguucagccgcgagaacuccuacagcggcguggagggggagggccugccgaagcucggcuacauccugcgggacaucuccaagauccccgggggcgcgauguacgccgacgacacggccgggugggacacccgcaucaccgaggacgaccugcacaacgaggagaagaucccccaccagauggaccccgagcacagccggcucgccaacgccaucuucaagcugaccuaccagaacaaggucgugaaggugcagcgcccgacgcccaccggcaccgucauggacaucaucucccggaaggcgcagcgcggcagcggccaggugggcaccuacgggcugaacaccuucacgaacauggaggcccagcucauccggcagauggagggcgagggggugcuguccaaggccgaccuggagaacccccaccuccccgagaagaagaucacccaguggcuggagaccaagggcgucgagcgccugaagcggauggccaucaccggcgacgacugcguggugaagccgaucgacgaccgcuucgccaacgcgcuccuggcccugaacgacauggggaagguccggaaggacaucccccaguggcagcccagcaagggcuggcacgacuggcagcagguccccuucugcucccaccacuuccacgagcucaucaugaaggacgggcgcaagcugguggucccgugccggccccaggacgagcugaucggccgcgcccggaucagccagggggccggcuggucccuccgcgagacggcgugccugggcaaggccuacgcccagauguggagccugauguacuuccaccgccgggaccuccgccuggccuccaacgccaucugcagcgcggugcccgugcacuggguccccaccucccggaccaccuggagcauccacgcccaccaccaguggaugacgaccgaggacaugcugaccguguggaaccgcguguggaucgaggacaacccguggauggaggacaagacccccgucacgaccugggagaacgugcccuaccucgggaagcgggaggaccaguggugcggcagccugaucgggcugaccucccgcgccaccugggcccagaacaucccgacggccauccagcagguccggagccucaucggcaacgaggaguuccuggacuacaugcccuccaugaagcgcuuccggaaggaggaggagagcgagggggcgaucugguga

SEQ ID NO: 9923 - RNA, 9873 nt, Artificial Sequence
  derived and/or modified CDS sequence (opt1) from DENV-3__FJ898464__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgugacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccauguucacccugaccguggccuggcgcacggcgacccugauccucgccggggucagccugcugccggugugccaguccagcuccaugcggaagaccgacuggcuccccauggccgucgccgccaugggcgugccgccccucccgcuguucaucuucagccucaaggacacccugaagcgccgcuccuggccccugaacgagggggugauggcggucggccucgugagcauccuggccuccagccugcuccggaacgacgugcccauggccggcccccuggucgccgggggccugcucaucgccugcuacgugaucacggggaccuccgcggaccugaccguggagaaggccgccgacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcguguucccguacagcauccccgcgacccugcucguguggcacaccuggcagaagcagacccagcgguccggcguccugugggacgugcccagcccgcccgagacgcagaaggccgagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccuccgucaagaaggaccugaucagcuacggcgggggcuggcggcucuccgcgcaguggcagaagggggaggagguccaggugaucgccgucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgcggagccggacggccccacccccgagcuggaggaggagauguucaagaagcggaaccucaccaucauggaccugcaccccgggagcggcaagacccgcaaguaccugccggccaucguccgggaggccaucaagcgccggcuccgcacgcugauccuggcccccacccgggugguggccgcggagauggaggaggcccucaaggggcugcccauccgcuaccagaccaccgccacgaaguccgagcacaccggccgggagaucgucgaccugaugugccacgccaccuucaccaugcgccuccugagccccgugcgggugccgaacuacaaccugaucaucauggacgaggcccacuucacggaccccgcguccaucgccgcccgcggguacaucagcacccgggucggcaugggcgaggccgcggccaucuucaugaccgccacgccgcccgggacggccgacgccuucccgcaguccaacgcgcccauccaggacgaggagcgcgacauccccgagcgcagcuggaacuccggcaacgaguggaucaccgacuucgccgggaagaccgugugguucgugcccagcaucaaggccggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggcggaccgggucaucgacccgcgccggugccucaagcccgugauccugacggacggccccgagcgcgugauccuggccgggcccaugccggucaccgccgccuccgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagucccggaagacguucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcgcucaaggaguucaaggacuucgccgccggccgcaagagcaucgcccuggaccuggugacggagaucgggcgggugcccucccaccucgcccaccgcacccggaacgcgcuggacaaccuggucaugcuccacaccagcgagcacggcgggcgcgccuaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucguccuggaguucuucaugauggugcuccugauccccgagcccgagaagcagcgcacgccccaggacaaccagcuggccuacguggucaucgggauccucacgcuggccgcgaucaucgccgccaacgagaugggccugcucgagaccaccaagcgggaccugggcauguccaaggagccggggguggugagccccaccuccuaccuggacgucgaccuccaccccgccagcgcguggacgcuguacgccguggccaccaccgugaucacccccaugcugcgccacacgaucgagaacuccaccgccaacgucagccucgccgcgaucgccaaccaggccguggugcugaugggccuggacaagggguggccgaucuccaagauggaccucggcgucccccugcuggcccucgggugcuacagccaggugaacccccugacccugaccgccgcggugcuccugcugaucacgcacuacgccaucaucggccccggccuccaggccaaggccacccgggaggcccagaagcgcaccgcggccgggaucaugaagaacccgaccgucgacggcaucaugacgaucgaccuggaccccgugaucuacgacuccaaguucgagaagcagcugggccaggugaugcuccugguccugugcgccgugcagcuccugcugaugcggaccagcugggcccucugcgaggcgcugacccuggccaccggccccaucacgacccucugggagggcucccccgggaaguucuggaacaccaccaucgccgugagcauggccaacaucuuccgcggcuccuaccuggccggggcgggccuggccuucagcaucaugaaguccgucgggacgggcaagcggggcaccgggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagacgacccaccacgccgugagccggggcuccgccaagcugcagugguucgucgagcgcaacauggugaucccggaggggcgggugaucgaccucggcugcgggcgcggcggguggagcuacuacugcgcgggccugaagaaggucaccgaggugcggggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccgcaccauccgcguccugaagaugguggagccguggcucaagaacaaccaguucugcaucaaggugcugaaccccuacaugcccacggucaucgagcaccuggagcggcuccagcgcaagcacggcgggaugcuggugcggaacccccugucccgcaacagcacccacgagauguacuggaucuccaacggcaccgggaacaucguggccagcgucaacauggugucccggcuccugcugaaccgcuucaccaugacgcaccggcgcccgaccaucgagaaggacguggaccucggcgccggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggcgaccgggagcgccuccagcaugaucaacggcgucgugaagcugcugaccaagcccugggacgucgugcccauggugacgcagauggccaugaccgacaccacccccuucgggcagcagcgcgucuucaaggagaagguggacacgcggaccccgcgcagcaugcccggcacccggcgcgugaugggcaucaccgccgaguggcucuggcggacgcuggggcgcaacaagaagccccggcugugcacccgcgaggaguucaccaagaagguccgcaccaacgcggccaugggcgccguguucacggaggagaaccagugggacuccgccaaggccgcgguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgcgauguacgccgacgacaccgccgggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcgcagcucauccggcagauggagggcgagggggugcugagcaaggccgaccuggagaacccccaccucccggagaagaagaucacccaguggcuggagacgaagggcgucgagcgccugaagcggauggccaucuccggcgacgacugcguggugaagcccaucgacgaccgcuucgccaacgcccuccuggcgcugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggccggcuggucccuccgcgagaccgccugccugggcaaggcguacgcccagauguggagccugauguacuuccaccgccgggaccuccgccuggccuccaacgccaucugcagcgccgugcccgugcacugggucccgaccucccggaccacguggagcauccacgcgcaccaccaguggaugaccaccgaggacaugcugaccguguggaaccgcguguggaucgaggacaaccccuggauggaggacaagacgcccgucaccaccugggagaacgugcccuaccucgggaagcgggaggaccaguggugcggcagccugaucgggcugaccucccgcgccacgugggcccagaacaucccgaccgccauccagcagguccggagccucaucggcaacgaggaguuccuggacuacaugcccuccaugaagcgcuuccggaaggaggaggagagcgagggggccaucugguga

SEQ ID NO: 9924 - RNA, 9873 nt, Artificial Sequence
  derived and/or modified CDS sequence (opt1) from DENV-3__JQ922556__SS-prME
accagccugugccucaugaugauccugcccgccgcccuggcguuccaccucaccucccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgggacaagcgguccgucgcccucgcgccccacgugggcauggggcuggacacccggacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggcccccgcccggggcgcccgccggauggccauccugggcgacaccgcguggguguucggguccgugggcgggguccucaacagccugggcaagauggugcaccagaucuucggguccgccuacaccgcccuguucagcggcguguccugggucaugaagaucggcaucggggugcuccugacguggaucggccugaacagcaagaacaccuccaugagcuucuccugcaucgccaucgggaucaucacccucuaccugggcgccgugguccaggcggacauggggugcgugaucaacuggaagggcaaggagcugaagugcggcagcgggaucuucgugaccaacgagguccacacguggaccgagcaguacaaguuccaggccgacucccccaagcgccucgccaccgccaucgccggcgcgugggagaacggggugugcggcauccgcagcaccacgcggauggagaaccugcuguggaagcagaucgccaacgagcucaacuacauccugugggagaacaacaucaagcugaccguggucgugggggacaccaucggcgugcucgagcagggcaagcgcacccugacgccgcagcccauggagcugaaguacuccuggaagaccugggggaaggccaagaucgucaccgccgagacccagaacagcuccuucaucaucgacggccccagcacgcccgagugcccguccgcgagccgggccuggaacgugugggagguggaggacuacggguucggcgucuucaccaccaacaucuggcucaagcugcgcgagguguacacccagaugugcgaccaccggcugaugagccccgccgugaaggacgagcgcgccguccacgccgacaugggcuacuggaucgagucccagaagaacgggagcuggaagcucgagaaggcgucccugaucgaggugaagaccugcacguggcccaagagccacacccugugguccaacggcgugcucgagagcgacaugaucaucccgaagucccuggccgggcccaucagccagcacaacuaccggcccggcuaccacacccagaccgccgggcccuggcaccugggcaagcucgagcuggacuucaacuacugcgagggcacgaccgucgugaucaccgagaacugcgggacccgcggcccgucccugcggacgaccaccgugagcgggaagcucauccacgaguggugcugccgcuccugcacccugccgccccugcgguacaugggcgaggacgggugcugguacggcauggagauccgccccaucagcgagaaggaggagaacauggucaagucccucgugagcgccggcuccgggaagguggacaacuucacgaugggcguccugugccuggccauccucuucgaggaggugaugcgggggaaguucggcaagaagcacaugaucgcggggguguucuucaccuucguccugcugcucagcggccagaucaccuggcgcgacauggcccacacccugaucaugaucggcuccaacgccagcgaccggauggggaugggcgugacguaccuggcccucaucgccaccuucaagauccagccguuccuggcgcugggguucuuccuccgcaagcugaccagccgggagaaccugcuccugggcgugggccuggccauggccaccacgcuccagcugcccgaggacaucgagcagauggccaacgggaucgcgcugggccucauggccuucaagcugaucacccaguucgagaccuaccagcuguggaccgcccucaucucccugacgugcagcaacaccaucuucacccugaccgucgccuggcgcacggccacccucauccuggcgggggugucccugcuccccgucugccagagcuccagcaugcggaagaccgacuggcugcccaugaccguggccgccaugggcgugccgccccugccccucuucaucuucucccugaaggacacgcugaagcgccgcagcuggccccucaacgagggggucauggccgugggccugguguccauccuggccagcucccuccugcggaacgacgucccgauggcgggcccccugguggccgggggccuccugaucgccugcuacguggggaccggcaccagcgccgaccugaccgucgagcaggccgcggacgugacgugggaggaggaggccgagcagaccggggugucccacaaccucaugaucaccgucgacgacgacggcaccaugcgcaucaaggacgacgagaccgagaacauccugacggugcugcucaagaccgcccugcugaucgugagcggcaucuuccccuacuccauccccgccacccuccuggucuggcacaccuggcagaagcagacgcagcggagcggggugcugugggacgugccgagcccgcccgagacccagaaggccgagcucgaggagggcgucuaccgcaucaagcagcaggggauccugggcaagacccaggugggggugggcguccagaaggagggcguguuccacaccauguggcacgugacgcgcggggcgguccugacccacaacggcaagcgccucgagcccaacugggccagcgugaagaaggaccugaucuccuacgggggcggguggcggcugagcccgcaguggcagaagggcgaggaggugcaggucaucaccguggagcccggcaagaaccccaagaacuuccagaccaugccggggacguuccagaccaccaccggcgagaucggggccaucgcccucgacuucaagcccggcacgagcggcucccccaucaucaaccgcgaggggaagguggucggccuguacgggaacggcguggugaccaagaacgggggcuacgucagcggcaucgcgcagaccaacgccgagcccgacgggccgacccccgagcuggaggaggagauguucaagaagcggaaccugacgaucauggaccuccaccccggcuccgggaagacccgcaaguaccugcccgccaucgugcgggaggccaucaaccgccggcugcgcacccucauccuggccccgacccggguggucgcggccgagauggaggaggcccugaagggccuccccauccgcuaccagacgaccgccaccaagagcgagcacaccgggcgggagaucguggaccugaugugccacgccacguucaccaugcgccugcucucccccgugcggguccccaacuacaaccugaucaucauggacgaggcgcacuucaccgacccggccagcaucgccgcccgcggcuacaucuccacccgggugggcaugggggaggccgcggccaucuucaugacggccacgccgcccggcaccgccgacgcguucccccagagcaacgccccgauccaggacgaggagcgcgacauccccgagcgcuccuggaacagcgggaacgaguggaucaccgacuucgccggcaagacggugugguucguccccuccaucaaggccgggaacgacaucgccaacugccugcggaagaacggcaagaaggugauccagcucagccgcaagaccuucgagaccgaguaccagaagaccaagcugaacgacugggacuucgugggcacgaccgacaucuccgagaugggggcgaacuucaaggccgaccgggucaucgacccccgccggugccugaagccgggcauccucaccgacgggcccgagggcgugauccuggccgggcccaugcccgugaccgccgccagcgcggcccagcgccggggccgcgucggccggaacccgcagaaggagaacgaccaguacaucuucaccgggcagccccugaacaacgacgaggaccacgcccacuggacggaggccaagaugcuccuggacaacaucaacacccccgagggcaucauccccgcccuguucgagccggagcgcgagaaguccgcggccaucgacggggaguaccggcucaagggcgagagccgcaagaccuucguggagcugaugcggcgcggcgaccugcccguguggcucgcccacaaggucgccuccgaggggaucaaguacaccgaccggaaguggugcuucgacggccagcgcaacaaccagauccuggaggagaacauggacguggagaucuggacgaaggagggggagaagaucaagcugcggccccgcuggcucgacgcgcggaccuacagcgacccgcuggcccugaaggaguucaaggacuucgccgccggccgcaaguccaucgcccucgaccuggucaccgagaucgggcgcgugcccagccaccuggcgcaccggacccgcaacgcccucgacaaccuggugaugcugcacacgagcgagcacggcggccgggccuaccgccacgccgucgaggagcuccccgagaccauggagacccugcugcuccuggggcugaugauccuccugaccggcggggccaugcuguuccucaucuccggcaaggggaucggcaagacgagcaucggccugaucugcgugaucgcguccagcgggaugcuguggauggccgagaucccccuccaguggaucgccuccgccaucgugcuggaguucuucaugaugguccugcucaucccggagcccgagaagcagcggacgccccaggacaaccagcuggccuacguggugaucggcauccugacccucgcggccaucaucgccgccaacgagauggggcugcuggagaccacgaagcgcgaccucggcgucagcaaggagcccggggugguguccccgaccagcuaccuggacgucgaccugcaccccgccuccgcguggacccucuacgccguggccaccacggugaucacccccaugcugcggcacaccaucgagaacagcaccgccaacgucucccuggcggccaucgccaaccaggccguggugcucaugggccuggacaagggcuggcccaucagcaagauggaccugggggucccgcuccuggcccugggcugcuacucccaggugaacccccucacgcugaccgcggccgugcugcuccugaucacccacuacgccaucaucgggcccggccugcaggccaaggccacccgcgaggcgcagaagcggacggccgccggcaucaugaagaaccccaccgucgacgggaucaucaccaucgaccucgacccggugaucuacgacagcaaguucgagaagcagcugggccaggugaugcugcucguccugugcgccgugcagcugcuccugaugcgcaccuccugggcccugugcgaggcgcucacgcuggccaccgggcccaucaccacccugugggagggcagccccgggaaguucuggaacacgaccaucgccguguccauggccaacaucuuccggggcagcuaccucgcgggcgccgggcuggccuucuccaucaugaaguccgucggcaccgggaagcgcggcaccgggagccagggcgagacccugggcgagaaguggaagaagaagcucaaccagcugagccggaaggaguucgaccuguacaagaaguccgggaucacggagguggaccgcaccgaggccaaggagggccucaagcgcggggagcugacccaccacgccgugucccgcggcagcgcgaagcugcagugguucgucgagcggaacauggugauccccgaggggcgcgugaucgaccucggcugcggccgcggcgggugguccuacuacugcgccgggcugaagaaggucaccgaggugcgcggguacacgaagggcggcccgggccacgaggagcccgugcccaugagcaccuacggguggaacaucgucaagcugauguccggcaaggacguguucuaccucccgcccgagaagugcgacacccugcugugcgacaucggggagagcucccccagccccaccguggaggagucccggacgauccgcguccugaagaugguggagcccuggcucaagaacaaccaguucugcaucaaggugcugaaccccuacaugcccgccgucaucgagcaccuggagcgccuccagcggaagcacggcggcaugcuggugcgcaacccccugagccggaacuccacccacgagauguacuggaucagcaacgggaccggcaacaucguguccagcgucaacauggugucccgccuccugcugaaccgguucaccaugacgcaccgccggccgaccaucgagaaggacguggaccucggggccggcacccgccacgucaacgccgagcccgagacccccaacauggacgugaucggggagcggaucaagcgcaucaaggaggagcacaacagcacguggcacuacgacgacgagaaccccuacaagaccugggcguaccacggcuccuacgaggugaaggccaccggcagcgggagcuccaugaucaacggcgucgugaagcugcugaccaagccgugggacgucgugcccauggugacgcagauggccaugaccgacaccacccccuucgggcagcagcgggucuucaaggagaagguggacacgcgcacgccccggccgaugcccggcacccgcaaggugauggagaucaccgccgaguggcucuggcggacgcuggggcgcaacaagcggccccgccugugcacccgggaggaguucaccaagaagguccgcaccaacgccgcgaugggcgccguguucacggaggagaaccagugggacagcgccaaggccgcgguggaggacgaggaguucuggaagcucgucgaccgcgagcgggagcugcacaagcugggcaagugcggguccugcguguacaacaugaugggcgggcgcgagaagaagcucggcgaguucgggaaggccaagggcagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgcgauguacgccgacgacaccgccgggugggacacccggaucaccgaggacgaccugcacaacgaggagaagaucacgcagcagauggacccggagcaccgccuccuggccaacgccaucuucaagcugaccuaccagaacaaggucgugaaggugcagcggcccacccccaccggcaccgucauggacaucaucucccgcaaggaccagcgggggagcggccaggugggcacguacgggcucaacaccuucaccaacauggaggcgcagcuggugcgccagauggagggcgaggggguccuguccaaggccgaccucgagaacccccaccuccccgagaagaagaucacccaguggcuggagacgaagggcguggagcggcugaagcgcauggccaucagcggggacgacugcguggucaagcccaucgacgaccgguucgccaacgcccugcuggcgcucaacgacaugggcaaggugcgcaaggacaucccccaguggcagcccuccaagggcuggcacgacuggcagcaggucccguucugcagccaccacuuccacgagcugaucaugaaggacgggcggaagcuggucgugcccugccgcccccaggacgagcucaucggccgggcccgcaucucccagggggccggcuggagccugcgggagaccgccugccuggggaaggccuacgcgcagauguggucccucauguacuuccaccgccgcgaccugcggcuggccagcaacgccaucugcuccgccgugcccguccacugggugaccaccagccgcacgaccuggagcauccacgcgcaccaccaguggaugaccaccgaggacaugcucacgguguggaaccgggucuggaucgaggacaacccguggauggaggacaagacccccgugaccaccugggagaacgugcccuaccugggcaagcgcgaggaccaguggugcggcucccugaucgggcucacgagccgggccaccugggcccagaacaucccgaccgccauccagcagguccgcucccugaucggcaacgaggaguuccuggacuacaugcccagcaugaagcgguuccgcaaggaggaggaguccgagggggccaucugguga

SEQ ID NO: 9925 - RNA, 9873 nt, Artificial Sequence
  derived and/or modified CDS sequence (opt1) from DENV-3__JQ922557__SS-prME
accagccugugccucaugaugauccugcccgccgcccuggcguuccaccucaccagccgcgacggggagccgcggaugaucguggggaagaacgagcgcggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagcggcuguccggcgccaccuggguggacgugguccuggagcacgggggcugcgugaccacgauggccaagaacaagcccacccucgacaucgagcugcagaagaccgaggccacccagcuggcgacgcuccgcaagcugugcaucgaggggaagaucaccaacaucaccaccgacagccggugccccacgcagggcgaggccgugcugccggaggagcaggaccagaacuacgucugcaagcacaccuacguggaccgcggcugggggaacggcugcggccuguucggcaaggggucccuggugaccugcgccaaguuccagugccuggagcccaucgagggcaaggucgugcaguacgagaaccucaaguacaccgugaucaucacgguccacaccggcgaccagcaccagguggggaacgagacccagggcgucaccgccgagaucacgccccaggccagcaccaccgaggcgauccugcccgaguacgggacccugggccucgagugcuccccgcggaccgggcuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggugaccuucaagaacgcccacgccaagaagcaggaggucguggugcugggcucccaggagggggcgaugcacaccgcccucacgggcgccaccgagauccagaacagcgggggcaccuccaucuucgccgggcaccugaagugccgccugaagauggacaagcucgagcugaagggcaugagcuacgccaugugcaccaacacguucguccugaagaaggagguguccgagacccagcacggcaccauccucaucaagguggaguacaagggggaggacgcgccgugcaagauccccuucagcaccgaggacggccaggggaaggcccacaacggccggcugaucacggccaaccccgucgugaccaagaaggaggagcccgugaacaucgaggccgagccgcccuucggcgagagcaacaucgucaucgggaucggcgacaacgcgcugaagaucaacugguacaagaagggguccagcaucggcaagauguucgaggccaccgcccgcggggcccggcgcauggccauccugggcgacaccgcgugggacuucggcuccgucggcggggugcucaacagccuggggaagaugguccaccagaucuucggguccgccuacacggcccuguucagcgggguguccugggugaugaagaucggcaucggcguccuccugaccuggaucgggcugaacagcaagaacaccuccaugagcuucuccugcaucgccaucggcaucaucacccucuaccugggggccguggugcaggcggacaugggcugcgucaucaacuggaaggggaaggagcugaagugcggcagcggcaucuucgugacgaacgaggugcacaccuggaccgagcaguacaaguuccaggccgacucccccaagcgccucgccaccgccaucgccggggcgugggagaacggcgucugcgggauccggagcacgacccgcauggagaaccugcuguggaagcagaucgccaacgagcucaacuacauccugugggagaacaacaucaagcugaccgugguggucggcgacaccaucggggugcucgagcagggcaagcggacgcugacgccccagccgauggagcugaaguacuccuggaagaccuggggcaaggccaagaucgugaccgccgagacgcagaacagcuccuucaucaucgacgggcccaacacccccgagugccccagcgcgucccgcgccuggaacgucugggagguggaggacuacggcuucgggguguucaccaccaacaucuggcucaagcugcgggaggucuacacccagaugugcgaccaccgccugaugagcgccgccgugaaggacgagcgggccgugcacgcggacaugggcuacuggaucgagagccagaagaacggcuccuggaagcucgagaaggccagccugaucgaggucaagacgugcaccuggccgaagucccacacccuguggagcaacggggugcucgaguccgacaugaucauccccaagagccuggccggccccaucucccagcacaacuaccgcccgggguaccacacccagacggccggccccuggcaccuggggaagcucgagcuggacuucaacuacugcgagggcaccaccguggucaucaccgagaacugcggcacgcgggggcccagccugcgcaccaccaccguguccggcaagcucauccacgaguggugcugccggagcugcacgcugcccccgcugcgcuacaugggggaggacggcugcugguacgggauggagauccggcccaucuccgagaaggaggagaacauggugaagucccucgucuccgccggcaagagcaagcgcgacaacuccaccaugggcgugcugugccuggcgauccucuucgaggaggugaugcgggggaaguucggcaagaagcacaugaucgccggggucuucuucaccuucgugcugcugcucagcggccagaucaccuggcgcgacauggcccacacgcugaucaugaucggguccaacgccagcgaccggaugggcaugggcgugaccuaccuggcccucaucgcgaccuucaagauccagcccuuccuggcccugggguucuuccuccgcaagcugaccagccgggagaaccugaugcucggcgucgggcuggccauggccacgacccugcagcuccccgaggacaucgagcagauggcgaacggcaucgcccugggccugauggcccucaagcugaucacccaguucgagaccuaccagcuguggacggcccucaucucccugaccugcagcaacaccaucuucacccugacgguggccuggcgcaccgcgacccucauccuggccggggugucccugcucccggucugccagagcuccagcaugcgcaagaccgacuggcugcccaugacgguggccgccaugggcgugccgccccugccccucuucaucuucucccugaaggacacccugaagcggcgcagcuggccccucaacgagggggugauggccgugggccuggucuccauccuggcgagcucccuccugcggaacgacgugcccauggccgggccccugguggccggcggccuccugaucgccugcuacgucaucaccgggaccagcgccgaccugacgguggagaaggcggccgacgugaccugggaggaggaggccgagcagaccggcgucucccacaaccuccugaucaccguggacgacaacgggaccaugcgcaucaaggacgacgagacggagaucauccugaccgugcuccugaagaccgcccugcagaucgucagcggcaucuucccguacuccauccccgccacccuccugguguggcacacguggcagaagcagacccagcggagcggggugcugugggacguccccagcccgcccgagacccagaaggcggagcucgaggagggcguguaccgcaucaagcagcagggcauccuggggaagacccaggugggcgucggggugcagaaggagggcguguuccacacgauguggcacgucacccgcggggccgugcugacccacaacggcaagcgccucgagcccaacugggccagcgugaagaaggaccugaucuccuacggcgggggcuggcggcugagcgcccaguggcagaagggggaggagguccaggugaucgcgguggagcccggcaagaaccccaagaacuuccagaccaugcccgggacguuccagaccaccaccggcgagaucggcgccaucgcccucgacuucaagcccgggacgagcggcucccccaucaucaaccgcgaggggaaggucgugggccuguacggcaacgggguggucaccaagaacggcgacuaccugagcgggaucgcccagaccaacgccgagccguacggccccucccccgaccuggaggaggagauguucaagaagcggaagcucaccaucauggaccugcaccccgggagcggccagacgcugaaguaccucccggcgaucgugcgcgacgccaucaagcggcgccugcggauccugauccucgcccccacccgcguggucgccgccgagauggaggaggcgcugaagggccugcccauccgguaccagaccaccgccacgaaguccgagcacaccgggcgcgagaucguggaccucaugugccacgccaccuucaccaugcggcugcugagccccgugcgcgucccgaacuacaaccucaucaucauggacgaggcccacuucacggaccccgccuccaucgcggcccggggcuacaucagcacccgcguggggaugggcgaggccgccgcgaucuucaugaccgccacgccgcccgggacggccgacgccuucccgcaguccaacgcccccauccaggacgcggagcgcgacauccccgagcggagcuggaacuccggcaacgaguggaucaccgacuucgccggcaagaccgugugguucguccccagcaucaaggccgggaacgacaucgccaacugccugcgcaagaacggcaagaaggugauccagcugucccggaagaccuucgagacggaguaccagaagaccaagcucaacgacugggacuucguggucaccaccgacaucagcgagaugggggccaacuucaaggcggaccgcgugaucgacccgcggcgcugccugaagcccgugauccugacggacggccccaagcgggucauccucgccgggcccaugccggacaccgccgccuccgccgcgcagcgccggggccgcgugggccggaacccccagaaggagaacgaccaguacaucuuccccgggcagccccugaacaccgacgaggaccacgcccacuggccggagaccaagcugcucauggaccuguucaccacgcccgagggcauccugcccagccacuucgacccccacggggagaacuucccggagaucuccggcgaguaccgccucaagggggagagccggaagaccuucguggagcugaugcgccggggcgaccugcccgucuggcucgcccacaagguggccuccgagggcaucaaguacaccgaccgcaaguggugcuucgacgggcagcggaacaaccagauccuggaggagaacauggacguggagaucuggaccaaggagggcgagaagaagaagcugcgcccccgguggcucgacgcgcgcacguacagcgacccgcuggcccugaaggaguucaaggacuucgccgccgggcgcaagagcaucgcccucgaccuggucaccgagaucggccgggugcccucccaccuggcgcaccgcacccggaacgcccucgacaaccuggucaugcugcacaccagcgagcacggcgggcgcgccuaccggcacgccguggaggagcuccccgagacgauggagacccugcugcuccugggccugaugauccuccugaccgggggcgccaugcuguuccucaucuccgggaagggcaucggcaagaccagcaucgggcugaucugcgugaucgcguccagcggcaugcuguggauggccgagaucccccuccaguggaucgccuccgccaucguccuggaguucuucaugauggugcugcucaucccggagcccgagaagcagcgcacgccccaggacaaccagcuggccuacguggucaucgggauccugacccucgcggccaucaucgccgccaacgagaugggccugcuggagaccaccaagcgggaccucgggaugagcaaggagcccggcgugguguccccgacgagcuaccuggacgucgacucccaccccgccagcgcguggacccuguacgccguggccaccaccgugaucacgcccaugcuccgccacaccaucgagaacuccaccgccaacgucagccuggcggccaucgccaaccaggccguggugcugaugggccucgacaagggguggcccaucuccaagauggaccugggcgucccgcugcucgcccuggggugcuacagccaggugaacccccugacccucacggcggccgugcugcugcucaucacccacuacgccaucaucggccccgggcugcaggccaaggccacccgggaggcgcagaagcgcaccgccgccggcaucaugaagaaccccacggucgacggcaucaucaccaucgaccuggacccggugaucuacgacuccaaguucgagaagcagcucggccaggugaugcugcugguccucugcgccgugcagcugcugcucaugcggaccagcugggcccugugcgaggcgcugacccucgccacgggccccaugaccacccugugggaggggucccccggcaagaucuggaacaccacgaucgccgugagcauggccaacaucuuccgcggcagcuaccuggcgggggccggccucgccuucuccaucaugaaguccgucgggaccggcaagcgggggaccggcucccagggcgagacccugggggagaaguggaagaagaagcugaaccagcucagccgcaaggaguucgaccuguacaagaaguccggcaucaccgagguggaccggacggaggccaaggaggggcugaagcgcggcgagaccacccaccacgccgugagccggggguccgcgaagcuccagugguucgucgagcgcaacauggugauccccgagggccgggugaucgaccugggcugcgggcgcggcggguggagcuacuacugcgccggccugaagaaggucaccgaggugcggggguacacgaagggcggcccggggcacgaggagcccgugcccauguccaccuacggcuggaacaucgucaagcucaugagcgggaaggacguguucuaccugcccccggagaagugcgacacccugcugugcgacaucggcgaguccagccccucccccaccguggaggagagccgcacgauccgcguccucaagaugguggagcccuggcugaagaacaaccaguucugcaucaaggugcugaacccguacaugcccgccgucaucgagcaccucgagcggcugcagcgcaagcacgggggcaugcuggugcggaacccccucucccgcaacagcacccacgagaugcacuggaucuccaacggcaccgggaacaucgugagcuccgucaacauggugagccggcugcugcucaaccgcuucaccaugacgcaccggcgcccgaccaucgagaaggacguggaccugggcgccgggacccggcacgucaacgccgagcccgagacccccaacauggacgugaucggcgagcgcaucaagcggaucaaggaggagcacaacagcacguggcacuacgacgacgagaaccccuacaagaccugggcguaccacggcuccuacgaggugaaggccaccgggagcgccuccagcaugaucaacggcgucgugaagcugcucaccaagccgugggacgugguccccauggugacgcagauggccaugaccgacaccacccccuucgggcagcagcgcgucuucaaggagaagguggacacgcggacgccccggccgaugcccggcacccggaaggugauggagaucaccgccgaguggcuguggcgcacgcuggggcggaacaagcgcccccggcucugcacccgcgaggaguucaccaagaagguccgcaccaacgcggccaugggcgccguguucacggaggagaaccagugggacuccgccaaggcggccguggaggacgaggaguucuggaagcuggucgaccgggagcgcgagcugcacaagcucggcaagugcgggagcugcguguacaacaugaugggcaagcgggagaagaagcugggggaguucggcaaggccaaggggucccgcgccaucugguacauguggcugggcgcccgguaccucgaguucgaggcgcugggcuuccugaacgaggaccacugguucagccgcgagaacuccuacagcgggguggagggcgaggggcuccacaagcugggcuacauccugcgggacaucuccaagauccccgggggcgccauguacgccgacgacaccgccggcugggacacccgcaucaccgaggacgaccuccacaacgaggagaagaucacgcagcagauggacccggagcaccggcugcuggccaacgcgaucuucaagcucaccuaccagaacaaggucgugaaggugcagcgccccacccccaccgggaccgucauggacaucaucagccggaaggaccagcgcggcuccggccaggugggcacguacggccugaacaccuucaccaacauggaggcccagcuggugcggcagauggagggggagggcguccucagcaaggccgaccuggagaacccccaccucccggagaagaagaucacccaguggcucgagacgaaggggguggagcgccugaagcggauggccaucuccggcgacgacugcguggucaagcccaucgacgaccgcuucgccaacgcgcugcucgcccugaacgacauggggaaggugcggaaggacaucccccaguggcagcccagcaagggcuggcacgacuggcagcaggucccguucugcucccaccacuuccacgagcugaucaugaaggacggccgcaagcucgucgugcccugccggccccaggacgagcugaucgggcgcgcccggaucagccagggcgccggguggucccugcgcgagaccgccugccucggcaaggcguacgcccagauguggagccugauguacuuccaccgccgggaccugcgccucgccagcaacgccaucugcuccgcggugcccguccacugggugccgaccagccggaccacgugguccauccacgcccaccaccaguggaugaccaccgaggacaugcugaccguguggaaccgcgucuggaucgaggacaaccccuggauggaggacaagacgcccgugaccaccugggagaacccgcccuaccuggggaagcgggaggaccaguggugcggcagcaucaucggccucuccagccgcgccaccugggcccagaacauccccacggccauccagcagguccggucccugaucgggaacgaggaguuccuggacuacaugcccagcaugaagcgcuuccggaaggaggaggaguccgagggcgcgaucugguga

SEQ ID NO: 9926 - RNA, 9873 nt, Artificial Sequence
  derived and/or modified CDS sequence (opt1) from DENV-3__JQ922555__SS-prME
accagccugugccugaugaugauccugcccgccgcccuggcguuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccaccccggguucaccauccucgcgcuguuccuggcccacuacaucggcaccucccucacccagaagguggugaucuucauccugcugaugcucgugacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugcccgaggagcaggaccagaacuacgucugcaagcacaccuacguggaccggggguggggcaacgggugcggccucuucgggaagggcucccuggugaccugcgccaaguuccagugccuggagagcaucgagggcaaggucgugcaguacgagaaccucaaguacaccgugaucaucacgguccacaccggggaccagcaccaggugggcaacgagacccagggggucaccgccgagaucacgccccaggccuccaccgcggaggccauccugcccgaguacggcacccuggggcucgagugcagcccccgcaccggccuggacuucaacgagaugauccugcucaccaugaagaacaaggccuggaugggccaccggcagaugcuguucgaccugccgacgcccuggaccuccgggaccaccacggagaccagcgccuggaaccgcaaggagcccuucgugaccuucaagaacgcccacaccaagaagcaggagguggucgugcucggcucccaggagggggcgaugcacacggcccugaccggcgccaccgagauccagaacagcgggggcaccuccaucuucgccggccaccugaagugccggcucaagauggacaagcuggagcugaaggggaugagcuacgccaugugcacgaacaccuucgugcucaagaaggaggucagcgagacccagcacggcaccauccuggugaagguggaguacaagggggaggacgcgcccugcaagaucccguucuccacggaggacggccagggcaaggcccacaacgggcgccugaucaccgccaaccccgucgugaccaagaaggaggagcccgugaacaucgaggccgagcccccguucggcgagagcaacaucgucaucgggaucggcgacaaggcgcucaagaucaacugguaccggaagggguccagcaucggcaagauguucgaggccaccucccgcggcgcccggcgcauggccauccugggggacacggccugggacuucggcagcgucggcggggugcugaacucccuggggaagaugguccaccagaucuucgggagcgcguacaccgcccucuucuccggcgugagcugggugaugaagaucgggaucggcguccugcugaccuggaucgggcucaacuccaagaacaccagcauguccuucagcugcaucgccaucggcaucaucacgcuguaccugggggccguggugcaggccgacaugggcugcgucaucaacuggaagggcaaggagcucaagugcggguccggcaucuucgugaccaacgaggugcacaccuggaccgagcaguacaaguuccaggcggacagccccaagcgccuggccacggccaucgccggggccugggagaacggcgucugcgggauccgguccaccacccgcauggagaaccugcucuggaagcagaucgcgaacgagcugaacuacauccugugggagaacaacaucaagcucaccgugguggucggcgacacgaucggcgugcuggagcaggggaagcggacccugacgccccagcccauggagcucaaguacagcuggaagaccuggggcaaggccaagaucgugacggccgagacccagaacuccagcuucaucaucgacgggccgaacacccccgagugccccagcgccucccgcgcguggaacgucugggagguggaggacuacggcuucggcguguucaccaccaacaucuggcugaagcugcgggaggucuacacgcagaucugcgaccaccgccucaugagcgccgccgugaaggacgagcgggccgugcacgccgacaugggguacuggaucgagucccagaagaacggcagcuggaagcuggagaaggcgucccugaucgaggucaagaccagcaccuggcccaagucccacacccucuggagcaacggggugcaggaguccgacaugaucauccccaagagccuggccggccccaucucccagcacaacuaccgccccggguaccacacgcagaccgccggcccguggcaccugggcaagcucgagcuggacuucaacuacugcgaggggaccaccguggucaucacggagaacugcggcacccgggggcccagccugcgcaccaccacgguguccggcaagcucauccacgaguggugcugccggagcugcacccugccgccccuccgcuacaugggggaggacggcugcugguacggcauggagauccggccgaucuccgagaaggaggagaacauggucaagagccucgccuccgccgggagcggcaaggucgacaacuucaccaugggggugcugugccuggcgauccucuucgaggaggugaugcgcggcaaguucgggaagaagcacaugaucgccggcguccuguucaccuucgugcugcuccugagcggccagaucacguggcgggacauggcccgcacccugaucaugaucggguccaacgccagcgaccggaugggcaugggggugaccuaccucgcccugaucgcgaccuucaagauccagcccuuccuggcccucggcuucuuccugcgcaagcugacgucccgggagaaccuccugcugggcgucgggcucgccauggccaccacccugcagcugcccgaggacaucgagcagauggcgaacggcaucgcccucgggcugauggcccugaagcucaucacccaguucgagacguaccagcuguggaccgcccuggugagccugaccugcuccaacaccaucuucacgcugaccguggccuggcgcaccgcgacccugauccucgccggcgucagccugcugcccgugugccaguccagcuccaugcgcaagacggacuggcucccgaugaccgucgccgccaugggggugccgccccugccccuguucaucuucagccucaaggacacccugaagcggcgcuccuggccgcugaacgagggcgugauggccgucggccucgugagcauccuggcguccagccugcuccggaacggggugcccauggccggcccccuggucgccgggggccugcucaucgccugcuacgugaucaccgggacguccgccgaccugaccguggagaaggcggccgacgucaccugggaggaggaggccgagcagaccggcgugagccacaaccugaugaucaccguggacgacgacggcacgaugcgcaucaaggacgacgagaccgagaacauccucaccguccugcugaagaccgcccuccugaucguguccgggaucuuccccuacagcaucccggccacgcugcucguguggcacaccuggcagaagcagacccagcgguccggcguccugugggacgugcccuccccgcccgagacccagaaggcggagcuggaggaggggguguaccgcaucaagcagcagggcaucuucgggaagacgcaggucggcgugggcgugcagaaggagggggucuuccacaccauguggcacgugacccggggcgccgugcucacccacaacgggaagcgccuggagccgaacugggccagcgucaagaaggaccugaucuccuacggcgggggcuggcggcucagcgcccaguggcagaagggcgaggagguccaggugaucgcggucgagcccgggaagaaccccaagaacuuccagacgaugcccggcaccuuccagaccaccuccggggagaucggcgccaucgcccuggacuucaagccgggcacgagcgggucccccaucaucaaccgcgagggcaaggugguggggcuguacggcaacggggucgugaccaagaacggcggcuacgugagcgggaucgcccagaccaacgccgagcccgacggcccgacccccgagcucgaggaggagauguucaagaagcggaaccugacgaucauggaccugcaccccggguccggcaagacccgcaaguaccugcccgcgaucguccgggaggccaucaagcgccggcuccgcacccugauccuggccccgacccgggugguggccgccgagauggaggaggcgcucaaggggcugcccauccgcuaccagacgaccgccaccaagagcgagcacaccggccgggagaucgucgaccugaugugccacgccacguucaccaugcgccuccugucccccgugcgggugcccaacuacaaccugaucaucauggacgaggcccacuucaccgacccggccagcaucgcggcccgcggcuacaucuccacccgcgucgggaugggcgaggccgccgcgaucuucaugacggccacgccgcccgggaccgccgacgccuucccccagagcaacgccccgauccaggacgaggagcgggacauccccgagcgcuccuggaacagcggcaacgaguggaucaccgacuucgcggggaagacggugugguucgugcccuccaucaaggccggcaacgacaucgccaacugccuccggaagaacggcaagaaggucauccagcugagccgcaagaccuucgacaccgaguaccagaagaccaagcugaacgacugggacuucguggugacgaccgacaucuccgagaugggggccaacuucaaggccgaccgggucaucgacccccgccggugccucaagccggugauccugaccgacggccccgagcgcgugauccuggcggggcccaugcccgucaccgccgccagcgccgcccagcggcgcggccggguggggcgcaacccgcagaaggagaacgaccaguacaucuucaccggccagccccucaacaacgacgaggaccacgcgcacuggacggacgccaagaugcugcuggagaacaucaacacccccgagggcaucauccccgcccucuucgagccggagcgggagaaguccgccgggcuggacggcgaguaccgccugaagggggagagccggaagaccuucguggagcucaugcgccggggcgaccugcccgucuggcuggcgcacaagguggccagcgagggcauccucuacaccgaccgcaaguggugcuucgacgggcagcggaacaaccagauccuggaggagaacauggacgucgagaucuggacgaaggagggcgagaagaagaagcugcgcccccgcuggcucgacgcccggaccuacuccgacccccuggcccugaaggaguucaaggacuucgccgcggggcgcaagagcaucgcccucgaccuggugaccgagaucggccggguguccagccaccuggcccaccgcacccggaacgcccucgacaacaagaugaugcugcacacguccgaguacgggggccgcgccuaccggcacgcggucgaggagcugccggagaccauggagacccuccugcugcucggccugaugauccugcucaccgggggcgccaugcuguuccugaucagcgggaagggcaucgggaagacguccaucggccucaucugcgugaucgccagcuccggcaugcuguggauggccgacgugccccugcaguggaucgccagcgcgaucguccucgaguucuucaugauggugcugcugauccccgagccggagaagcagcgcacgccccaggacaaccagcucgccuacguggucaucgggauccugacccuggccgccaucaucgccgcgaacgagaugggccuccuggagaccacgaagcgggaccuggggguguccaaggagcccggcguggucagccccaccuccuaccucgacguggaccugcacccggccagcgccuggacccuguacgccguggcgaccacggucaucgcccccaugcuccgccacaccaucgagaacuccaccgccaacgugagcauggccgccaucgcgaaccaggccgugguccugauggggcuggacaagggcuggcccaucuccaagauggaccucggcgugccccugcuggcccucgggugcuacuucuacgugaacccgcugacccugacggccgccgucuuccuccuggugacccacuacgcgaucaucggccccgggcugcaggccaaggccacccgggaggcccacaagaagaccgccgcgggcaucaugaacccgccgcccggcgacgggaucaugacgaucgaccucgaccccgugaucuacgacagcaaguucgagaagcagcugggccaggucaugcugcucgugcugugcgccgugcagcugcuccugaugcgcaccuccugggcccugugcgaggcccucacccuggcgaccgggcccacgaccacccugugggagggcagccccgggaaguucuggaacaccacgaucgccgucagcauggccaacaucuuccggggcuccuaccucgccggcgccgggcuggcguucagcaucaugaaguccgugggcaccgggaagcgcggcaccgggagccagggcgagacccugggcgagaaguggaagaagaagcucaaccagcugucccggaaggaguucgaccuguacaagaaguccgggaucaccgagguggaccgcacggaggccaaggagggccucaagcgcggggagaucacccaccacgccgucucccgcggcagcgccaagcugcagugguucguggagcggaacauggugauccccgaggggcgcgucaucgaccugggcugcggcaagggcgggugguccuacuacugcgccgggcucaagaaggugaccgaggugcggggcuacaccaagggcgggcccggccacgaggagcccguccccaugagcacguacggguggaacaucgugaagcugauguccggcaaggacguguucuaccugccgcccgagaagugcgacacccuccugugcgacaucggggagagcucccccagccccaccgucgaggagucccgcaccauccgcgugcugaagaugguggagccguggcucaagaacaaccaguucugcaucaagguccugaaccccuacaugcccacggugaucgagcaccuggagcggcugcagcgcaagcacggcggcaugcucgugcggaacccccugagccgcaacucccggaacgagauguacuggaucagcaacgggaccggcaacaucgucuccagcgugaacauggugagccgccugcuccugaaccgguucaccaugacccaccgccggccgacgaucgagaaggacgucgaccugggggcgggcacccgccacgugaacgccgagcccgagacccccaacauggacgugaucggggagcggaucaagcgcaucaaggaggagcacaacuccaccuggcacuacgacgacgagaacccguacaagacgugggccuaccacggcagcuacgaggucaaggccaccggcuccgccagcuccaugaucaacgggguggucaagcuccugaccaagcccugggacguggugcccauggucacccagauggcgaugacggacaccacccccuucggccagcagcggguguucaaggagaagguggacacccgcacgccgcggcugaugccccgcacccggaaggucauggagaucaccgccgaguggcucuggcgcacccuggggcggaacaagcgcccccgccugugcacgcgggaggaguucaccaagaaggugcgccccaucgccgccaugggcgcgguguucacccagcgggaccagugggacagcgccaaggccgccgucgaggacgaggaguucuggaagccgguggaccgcgagugcaacucccaccagcucgggaagugcggcagcugcguguacaacaugaugggcaagcgggagaagaagcugggggaguucggcaaggccaaggggucccgcgcgaucugguacauguggcugggcgcccgguaccucgaguucgaggcccugggguuccugaacgaggaccacugguucagccgcgagaacuccuacagcggcgucgagggcgaggggcuccacaagcugggcuacauccugcgggacaucuccaagauccccgggggcgccauguacgccgacgacaccgcgggcugggacacgcgcaacaccgaggacgaccuccacaugaaggagaagaucacccagcagauggggcccggccacagccggcuggccaacgccaucuucaagcugaccuaccagaacaagguggugaagguccagcgccccacgccgaccgggaccgugauggacaucaucucccggaaggaccagcgcggcagcggccaggugggcaccuacggccucaacaccuucacgaacauggaggcccagcugguccggcagauggagggggagggcgugcuguccaaggccgaccucgagaacccccaccuccuggagaagaagaucacccaguggcucgagaccaaggggguggagcgccugaagcggauggcgaucagcggcgacgacugcgucgugaagcccaucgacgaccgcuucgccaacgcccugcucgcccugaacgacauggggaaggugcggaaggacaucccccaguggcagccguccaagggcuggcacgacuggcagcagguccccuucugcagccaccacuuccacgagcugaucaugaaggacggccgcaagcucguggugcccugccggccccaggacgagcugaucgggcgcgcccgcaucagccagggcgcgggguggucccugcgggagaccgccugccucggcaaggccuacgcccagauguggagccugauguacuuccaccgccgggaccugcgccucgcguccaacgccaucugcagcgccgucccggugcacugggugcccacgucccggaccaccuggagcauccacgcccaccaccaguggaugaccacggaggacaugcugaccgucuggaaccgcguguggaucgaggacaaccccuggauggaggacaagacccccgugaccacgugggagaacgucccguaccuggggaagcgggaggaccaguggugcggcucccucaucggccugaccagccgcgccaccugggcgcagaacauccccaccgccauccagcagguccggucccugaucgggaacgaggaguuccucgacuacaugcccagcaugaagcgcuuccggaaggaggaggaguccgagggcgccaucugguga

SEQ ID NO: 9927 - RNA, 9873 nt, Artificial Sequence
  derived and/or modified CDS sequence (opt1) from DENV-3__GU131903__SS-prME
accagccugugccucaugaugaugcugcccgccacccuggccuuccaccucaccagccgggacggcgagccccggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccagcacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacuccggccgccugaucaccgccaaccccguggucacgaagaaggaggagcccgugaacaucgaggccgagccgcccuucggggagagcaacaucgugaucggcaucggggacaaggcccucaagaucaacugguacaagaagggcuccagcaucgggaagauguucgaggcgaccgcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucacguggaucggccugaacagcaagaacaccuccaugagcuucuccugcaucgugaucgggaucaucacccuguaccucggcgccgucgugcaggccgacauggggugcgugaucaacuggaagggcaaggagcugaagugcggcagcgggaucuucgucaccaacgaggugcacacguggaccgagcaguacaaguuccaggccgacucccccaagcgccuggcgaccgccaucgccggcgccugggagaacggggugugcggcauccgcagcaccacgcggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacuccuggaagacgugggggaaggcgaagaucgugaccgccgagacccagaacagcuccuucaucaucgacggccccaacacccccgagugccccaacgccagccgggccuggaacgugugggaggucgaggacuacggguucggcguguucacgaccaacaucuggcugaagcuccgcgagguguacacccagagcugcgaccaccggcugauguccgcggccaucaaggacgagcgcgccguccacgccgacaugggcuacuggaucgagagccagaagaacggguccuggaagcuggagaaggccagcuucaucgaggugaagaccugcaccuggccgaagucccacacgcucuggagcaacggcgugcuggaguccgacaugaucauccccaagagccuggcggggcccaucucccagcacaaccaccggccgggcuaccacacccagaccgccgggcccuggcaccucggcaagcuggagcuggacuucaacuacugcgagggcaccacggucgugaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucaacgagaaggaggagaacauggucaagucccuggugagcgccggcuccgggaagguggacaacuucaccaugggcguccugugccucgccauccuguucgaggaggugaugcgggggaaguucggcaagaagcacaugaucgccggggugcuguucacguucguccuccugcugagcggccagaucaccuggcgcgacauggcgcacacccucaucaugaucggcuccaacgccagcgaccggauggggaugggcgugaccuaccuggcccugaucgccacguucaagauccagcccuuccucgcccugggguucuuccugcgcaagcucaccagccgggagaaccugcugcucggcgugggccuggcgauggccaccacccugcagcuccccgaggacaucgagcagauggccaacgggaucgcccugggccugaugacgcucaagcugaucacccaguucgagaccuaccagcuguggaccgcgcucgucucccugacgugcagcaacaccaucuucacccugaccguggccuggcgcacggccacccucauccuggccggggucucccugcucccgcugugccagagcuccagcaugcggaagaccgacuggcugcccaugaccguggccgcgaugggcgugccgccccugccgcuguucaucuucucccugaaggacacgcccaagcgccgcagcuggccccucaacgagggggucauggccgugggccugguguccauccuggccagcucccuccugcggaacgacguccccauggccggcccgcugguggccgggggccuccugaucgcgugcuacgugaucaccgggaccagcgccgaccugaccgucgagaaggccgccgacgugacgugggaggaggaggccgagcagaccggcgugucccacaaccucaugaucaccgucgacgacgacgggaccaugcgcaucaaggacgacgagaccgagaacauccugacggugcugcucaagaccgcgcugcugaucgugagcggcaucuuccccuacuccauccccgccacccuccuggucuggcacaccuggcagaagcagacgcagcggagcggcgugcugugggacgugcccuccccgcccgagacccagaaggccgagcucgaggagggggucuaccgcaucaagcagcagggcaucuucgggaagacccaggugggcguggggguccagaaggagggcguguuccacaccauguggcacgugacgcggggcgccguccugacccacaacgggaagcgccuggagcccaacugggccagcgugaagaaggaccucaucuccuacggcgggggcuggcggcugaacgcgcaguggcagaagggggaggaggugcaggucaucgccguggagcccggcaagaacccgaagaacuuccagaccaugcccggcaucuuccagaccacgaccggggagaucggcgccaucgcccuggacuucaagcccgggaccagcggcagcccgaucaucaaccgcgagggcaagguggucgggcuguacggcaacgggguggugaccaagaacggcggguacgucuccggcaucgcgcagacgaacgccgagcccgacggccccacccccgagcucgaggaggagauguucaagaagcggaaccugaccaucauggaccugcacccggggagcggcaagacccgcaaguaccuccccgccaucgugcgggaggccaucaagcgccggcugcgcacgcugauccucgcccccacccggguggucgcggccgagauggaggaggcccugaaggggcugcccauccgcuaccagaccaccgccacgaaguccgagcacaccggccgggagaucguggaccucaugugccacgccaccuucaccaugcgccugcugagcccggugcggguccccaacuacaaccucgugaucauggacgaggcgcacuucacggaccccgccuccaucgccgcccgcggguacaucagcacccgggugggcaugggcgaggccgcggccaucuucaugaccgccacgccgcccgggacggccgaggcguucccccaguccaacgcccccauccaggacgaggagcgcgacauccccgagcgcagcuggaacuccggcaacgaguggaucaccgacuucgucgggaagaccgugugguucgugcccagcaucaaggccggcaacgacaucgccaacugccugcggaagaacgggaagaaggucauccagcugucccgcaagaccuucgacacggaguaccagaagacccggcucaacgacugggacuucguggugaccaccgacaucagcgagaugggcgccaacuucaaggcggaccgcgucaucgacccccggcgcugccugaagcccgugauccugacggacggccccgagcgggugauccucgccgggccgaugcccgucaccgccgccuccgccgcgcagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgccgcgaucgacggcgaguaccggcugaagggcgagucccgcaagacguucgucgagcucaugcggcgcggggaccugcccguguggcuggcccacaagguggccagcgagggcaucaaguacaccgaccggaaguggugcuucgacggggagcgcaacaaccagauccucgaggagaacauggacgucgagaucuggaccaaggagggcgagcggaagaagcugcgcccgcgcuggcuggacgcccggaccuacuccgacccccucgcgcugaaggaguucaaggacuucgccgccggccgcaagagcaucgcccuggaccucgugacggagaucgggcgggugcccucccaccuggcccaccgcacccggaacgcgcuggacaaccucgucaugcugcacaccagcgagcacggcgggcgcgccuaccggcacgccguggaggagcugccggagaccauggagacgcuccugcugcucggccugaugauccugcucaccgggggcgccaugcuguuccugaucagcggcaaggggaucggcaagaccuccaucgggcucaucugcgugaucgucagcuccggcaugcuguggauggccgacgugccccugcaguggaucgcgagcgccaucgugcucgaguucuucaugaugguccugcugauccccgagcccgagaagcagcgcaccccgcaggacaaccagcucgccuacguggugaucgggauccugacgcuggccgccaucgucgcggccaacgagaugggccuccuggagaccaccaagcgggaccugggcauguccaaggagcccgggguggugagccccaccuccuaccucgacgucgaccugcaccccgccagcgccuggacgcuguacgccguggcgaccaccgugaucaccccgaugcuccgccacacgaucgagaacuccaccgccaacgucagccuggccgccaucgcgaaccaggccguggugcugaugggccucgacaagggguggcccaucuccaagauggaccugggcgucccccugcucgcccuggggugcuacagccaggugaacccccugacccucaccgccgccgugcugcugcucgucacgcacuacgcgaucaucggcccgggccugcaggccaaggccacccgggaggcccagaagcgcaccgccgcggggaucaugaagaaccccaccguggacggcaucaugacgaucgaccuggaccccgugaucuacgacuccaaguucgagaagcagcucgggcaggucaugcugcuggugcucugcgccgugcagcugcugcucaugcggaccagcugggcccugugcgaggcccugacccucgccaccggccccaucacgacccugugggagggcuccccggggaaguucuggaacaccaccaucgcggucagcauggccaacaucuuccgcggcuccuaccuggccggggccggccucgcguucagcaucaugaaguccguggggacgggccggcgcggcaccgggagccagggcgagacccugggggagaaguggaagaagaagcugaaccagcucagccggaaggaguucgaccuguacaagaaguccggcaucaccgagguggaccgcaccgaggccaaggaggggcugaagcggggcgagacgacccaccacgccgucagccgcggcuccgccaagcuccagugguucguggagcggaacauggugauccccgaggggcgcgucaucgaccugggcugcgggcgcggcggguggagcuacuacugcgccggccugaagaaggugaccgaggugcggggcuacaccaaggcggggcccggccacgaggagcccgucccgauguccacguacggguggaacaucgugaagcucaugagcggcaaggacguguucuaccugccgcccgagaagugcgacacccugcugugcgacaucggggaguccagccccuccccgaccgucgaggagagccgcaccauccgggugcucaagaugguggagcccuggcugcgcaacaaccaguucugcaucaagguccugaaccccuacauggccacgggcaucgagcaccucgagcggcugcagcgcaaguacggcgggaugcuggugcggaacccccucucccgcaacagcacccacgagauggacuggaucuccaacggcaccgggaacaucgugagcuccgucaacauggugagccggcugcugcucaaccgcuucaccaugacgcaccggcgcccgaccaucgagaaggacgucgaccugggcgccggcacccggcacgugaacgccgagcccgagacccccaacauggacgugaucggggagcgcaucaagcggaucaaggaggagcacuccagcacguggcacuacgacgacgagaacccguacaagaccugggccuaccacggcuccuacgaggucaaggcgaccgggagcgccagcuccaugaucaacggcguggugaagcugcucaccaagcccugggacgucgugcccauggugacgcagauggccaugaccgacaccacccccuucgggcagcagcgcgucuucaaggagaagguggacacgcggaccccgcgccccaugcccggcacccggaaggugauggagaucaccgccgaguggcuguggcgcacgcugggccgcaacaagaagccccggcucugcacccgcgaggaguucaccaagaagguccggaccaacgccgcgaugggggccguguucacggaggagaaccagugggacagcgcccgcgccgcgguggaggacgaggaguucuggaagcuggucgaccgggagcgcgagcugcacaagcucggcaagugcggguccugcguguacaacaugaugggcaagcgggagaagaagcugggggaguucggcaaggccaagggcagccgcgccaucugguacauguggcugggggcccgguaccucgaguucgaggcccugggcuuccugaacgaggaccacugguucucccgcgagaacagcuacuccgggguggagggcgaggggcuccacaagcugggcuacauccugcgggacaucagcaagaucccgggcggggcgauguacgccgacgacaccgccggcugggacacccgcaucaccgaggacgaccuccacaacgaggagaagaucacgcagcagauggaccccgagcaccggcagcuggccaacgccaucuucaagcugaccuaccagaacaaggucgugaaggugcagcgccccacccccaaggggaccgucauggacaucaucucccggaaggaccagcgcggcagcggccagguggggaccuacggccucaacacguucaccaacauggaggcgcagcuggugcggcagauggagggggagggcguccuguccaaggccgaccucgagaacccgcaccuccuggagaagaagaucacccaguggcucgagaccaaggggguggagcgccugaagcggauggccaucagcggcgacgacugcguggucaagcccaucgacgaccgcuucgccaacgcccugcucgcgcugaacgacaugggcaaggugcggaaggacaucccccaguggcagcccuccaagggguggcacgacuggcagcaggucccguucugcagccaccacuuccacgagcugaucaugaaggacggccgcaagcucgucgugcccugccgcccccaggacgagcugaucgggcgggcccgcaucucccagggcgccggguggagccugaaggagacggccugccucggcaaggccuacgcgcagauguggucccugauguacuuccaccggcgcgaccugcggcucgccagcaacgccaucugcuccgccgugcccguccacuggaucccgaccagccgcaccaccuggagcauccacgcgcaccaccaguggaugacgaccgaggacaugcugaccguguggaaccggguguggaucgaggacaaccccuggauggaggacaagacccccgucacgaccugggaggacgugcccuaccugggcaagcgcgaggaccaguggugcgggucccucaucggccugaccagccgggccaccugggcccagaacauccugacggccauccagcagguccgcucccucaucggggacgaggaguuccuggacuacaugccgagcaugaagcgguuccgcaaggaggaggaguccgagggcgccaucugguga

SEQ ID NO: 9928 - RNA, 9873 nt, Artificial Sequence
  derived and/or modified CDS sequence (opt1) from DENV-3__GU131904__SS-prME
accagccugugccucaugaugaugcugcccgccacccuggccuuccaccucaccagccgggacggggagccgcggaugaucguggggaagaacgagcgcggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaaggucgagaccugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacacguggaccgagcaguacaaguuccaggccgacagccccaagcgccuggcgaccgccaucgccggcgccugggagaacggggugugcggcauccgcuccaccacgcggauggagaaccuccuguggaagcagaucgccaacgagcugaacuacauccucugggagaacagcaucaagcugaccgucguggugggggacaucaucggcguccuggagcagggcaagcgcacccucacgccccagccgauggagcugaaguacuccuggaagacgugggggaaggcgaagaucgugaccgccgagacccagaacagcuccuucaucaucgacggccccaacacccccgagugccccagcgccagccgggccuggaacgugugggaggucgaggacuacggguucggcguguucacgaccaacaucuggcugaagcuccgcgagguguacacccaguccugcgaccaccggcugaugagcgcggccaucaaggacgagcgcgccguccacgccgacaugggcuacuggaucgagucccagaagaacgggagcuggaagcuggagaaggccuccuucaucgaggugaagaccugcaccuggcccaagagccacacgcucugguccaacggcgugcuggagagcgacaugaucauccccaagucccuggcggggcccaucagccagcacaaccaccggccgggcuaccacacccagaccgccgggcccuggcaccucggcaagcuggagcuggacuucaacuacugcgagggcaccacggucgugaucaccgagaacugcgggacccgcggccccucccuccggaccacgaccgugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgccggggugcuguucacguucguccuccugcuguccggccagaucaccuggcgcgacauggcgcacacccucaucaugaucggcagcaacgccagcgaccggauggggaugggcgugaccuaccuggcccugaucgccacguucaagauccagcccuuccucgcccugggguucuuccugcgcaagcucaccucccgggagaaccugcugcucggcgugggccuggcgauggccaccacccugcagcuccccgaggacaucgagcagauggccaacgggaucgcccugggccugaugacgcucaagcugaucacccaguucgagaccuaccagcuguggaccgcgcucgucagccugacgugcuccaacaccaucuucacccugaccguggccuggcgcacggccacccucauccuggccggggucagccugcucccgcugugccaguccagcuccaugcggaagaccgacuggcugcccaugaccguggccgcgaugggcgugccgccccugccgcuguucaucuucagccugaaggacacgcccaagcgccgcuccuggccccucaacgagggggucauggccgugggccuggugagcauccuggccuccagccuccugcggaacgacguccccauggccggcccgcugguggccgggggccuccugaucgcgugcuacgugaucaccgggaccuccgccgaccugaccgucgagaaggccgccgacgugacgugggaggaggaggccgagcagaccggcgugagccacaaccucaugaucaccgucgacgacgacgggaccaugcgcaucaaggacgacgagaccgagaacauccugacggugcugcucaagaccgcgcugcugaucguguccggcaucuuccccuacagcauccccgccacccuccuggucuggcacaccuggcagaagcagacgcagcgguccggcgugcugugggacgugcccagcccgcccgagacccagaaggccgagcucgaggagggggucuaccgcaucaagcagcagggcaucuucgggaagacccaggugggcguggggguccagaaggagggcguguuccacaccauguggcacgugacgcggggcgccguccugacccacaacgggaagcgccuggagcccaacugggccuccgugaagaaggaccucaucagcuacggcgggggcuggcggcugagcgcgcaguggcagaagggggaggaggugcaggucaucgccguggagcccggcaagaacccgaagaacuuccagaccaugcccggcaucuuccagaccacgaccggggagaucggcgccaucgcccuggacuucaagcccgggaccuccggcagcccgaucaucaaccgcgagggcaagguggucgggcuguacggcaacgggguggugaccaagaacggcggguacgucuccggcaucgcgcagacgaacgccgagcccgacggccccacccccgagcucgaggaggagauguucaagaagcggaaccugaccaucauggaccugcacccggggagcggcaagacccgcaaguaccuccccgccaucgugcgggaggccaucaagcgccggcugcgcacgcugauccucgcccccacccggguggucgcggccgagauggaggaggcccugaaggggcugcccauccgcuaccagaccaccgccacgaaguccgagcacaccggccgggagaucguggaccucaugugccacgccaccuucaccaugcgccugcugagcccggugcggguccccaacuacaaccucgugaucauggacgaggcgcacuucacggaccccgccuccaucgccgcccgcggguacaucagcacccgggugggcaugggcgaggccgcggccaucuucaugaccgccacgccgcccgggacggccgaggcguucccccaguccaacgcccccauccaggacgaggagcgcgacauccccgagcgcagcuggaacuccggcaacgaguggaucaccgacuucgucgggaagaccgugugguucgugcccagcaucaaggccggcaacgacaucgccaacugccugcggaagaacgggaagaaggucauccagcugucccgcaagaccuucgacacggaguaccagaagacccggcucaacgacugggacuucguggugaccaccgacaucagcgagaugggcgccaacuucaaggcggaccgcgucaucgacccccggcgcugccugaagcccgugauccugacggacggccccgagcgggugauccucgccgggccgaugcccgucaccgccgccuccgccgcgcagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgccgcgaucgacggcgaguaccggcugaagggcgagucccgcaagacguucgucgagcucaugcggcgcggggaccugcccguguggcuggcccacaagguggccagcgagggcaucaaguacaccgaccggaaguggugcuucgacggggagcgcaacaaccagauccucgaggagaacauggacgucgagaucuggaccaaggagggcgagcggaagaagcugcgcccgcgcuggcuggacgcccggaccuacuccgacccccucgcgcugaaggaguucaaggacuucgccgccggccgcaagagcaucgcccuggaccucgugacggagaucgggcgggugcccagccaccuggcccaccgcacccggaacgcgcuggacaaccucgucaugcugcacaccuccgagcacggcgggcgcgccuaccggcacgccguggaggagcugccggagaccauggagacgcuccugcugcucggccugaugauccugcucaccgggggcgccaugcuguuccugaucagcggcaaggggaucggcaagaccuccaucgggcucaucugcgugaucgccagcuccggcaugcuguggauggcggacgucccccugcaguggaucgccagcgccaucgugcucgaguucuucaugauggugcugcugauccccgagcccgagaagcagcgcaccccgcaggacaaccagcucgccuacgucgugaucgggauccugacgcuggccgcgaucguggccgccaacgagaugggccuccuggagaccaccaagcgggaccugggcauguccaaggagcccggggucgugagccccaccuccuaccucgacguggaccugcaccccgccagcgccuggacgcuguacgcggucgccaccaccgugaucaccccgaugcuccgccacacgaucgagaacuccaccgccaacgugagccuggccgcgaucgccaaccaggccgucgugcugaugggccucgacaagggguggcccaucuccaagauggaccugggcgugccccugcucgcccuggggugcuacagccaggucaacccccugacccucaccgccgcggugcugcugcucgugacgcacuacgccaucaucggcccgggccugcaggccaaggccacccgggaggcccagaagcgcaccgcggccgggaucaugaagaaccccaccgucgacggcaucaugacgaucgaccuggaccccgugaucuacgacuccaaguucgagaagcagcucggccaggugaugcugcugguccucugcgccgugcagcugcugcucaugcggaccagcugggcccugugcgaggcccugacccucgcgaccggccccaucacgacccugugggagggcuccccggggaaguucuggaacaccaccaucgccgugagcauggccaacaucuuccgcggcuccuaccuggccggggcgggccucgccuucagcaucaugaaguccgucgggacgggccggcgcggcaccgggucccagggcgagacccugggggagaaguggaagaagaagcugaaccagcucagccggaaggaguucgaccuguacaagaaguccggcaucaccgagguggaccgcaccgaggccaaggaggggcugaagcggggcgagacgacccaccacgccgugagccgcggcuccgccaagcuccagugguucgucgagcggaacauggugauccccgaggggcgcgugaucgaccugggcugcgggcgcggcggguggagcuacuacugcgcgggccugcggaaggucaccgaggugcgcggcuacaccaagggcgggcccgggcacgaggagcccgugccgauguccacguacggcuggaacaucgucaagcucaugagcgggaaggacguguucuaccugccgcccgagaagugcgacacccugcugugcgacaucggcgaguccagccccuccccgaccguggaggagagccggaccauccgcguccucaagaugguggagcccuggcugcggaacaaccaguucugcaucaaggugcugaaccccuacaugcccacggucaucgagcaccucgagcgccugcagcggaaguacggcgggaugcuggugcgcaacccgcucucccggaacagcacccacgagauguacuggaucuccaacggcaccgggaacaucgugagcuccgucaacauggugagccgccugcugcucaaccgguucaccaugacgcaccgccggcccaccaucgagaaggacgucgaccugggcgccggcacccgccacgugaacgccgagcccgagaccccgaacauggacgugaucggggagcggaucaagcgcaucaaggaggagcacuccagcacguggcacuacgacgacgagaaccccuacaagaccugggccuaccacggcagcuacgaggucaaggccaccggguccgcgagcuccaugaucaacggcguggugaagcugcucaccaagcccugggacgucgugcccauggugacgcagauggccaugaccgacaccaccccguucgggcagcagcgggucuucaaggagaagguggacacgcgcacgccccggcccauggccggcacccgcaaggugauggagaucaccgccgaguggcuguggcgcacgcugggccggaacaagaagccccgccucugcacccgggaggaguucaccaagaagguccgcaccaacgccgcgaugggggccguguucacggaggagaaccagugggacagcgcccgggccgcgguggaggacgaggaguucuggaagcuggucgaccgcgagcgggagcugcacaagcucggcaagugcggguccugcguguacaacaugaugggcaagcgcgagaagaagcugggggaguucggcaaggccaagggcagccgggccaucugguacauguggcugggggcccgcuaccucgaguucgaggcccugggcuuccugaacgaggaccacugguucucccgggagaacagcuacuccgggguggagggcgaggggcuccacaagcugggcuacauccugcgcgacaucagcaagaucccgggcggggcgauguacgccgacgacaccgccggcugggacacccggaucaccgaggacgaccuccacaacgaggagaagaucacgcagcagauggaccccgagcaccgccagcuggccaacgccaucuucaagcugaccuaccagaacaaggucgugaaggugcagcggcccacccccaaggggaccgucauggacaucaucucccgcaaggaccagcggggcagcggccagguggggaccuacggccucaacacguucaccaacauggaggcgcagcuggugcgccagauggagggggagggcguccuguccaaggccgaccucgagaacccgcaccuccuggagaagaagaucacccaguggcucgagaccaaggggguggagcggcugaagcgcauggccaucagcggcgacgacugcguggucaagcccaucgacgaccgguucgccaacgcccugcucgcgcugaacgacaugggcaaggugcgcaaggacaucccccaguggcagcccuccaagggguggcacgacuggcagcaggucccguucugcagccaccacuuccacgagcugaucaugaaggacggccgcaagcucgucgugcccugccggccccaggacgagcugaucgggcgcgcccggaucucccagggcgccggguggagccugaaggagacggccugccucggcaaggccuacgcgcagauguggucccugauguacuuccaccgccgggaccugcgccucgccagcaacgccaucugcagcgccgugcccguccacuggaucccgaccucccggaccaccuggagcauccacgcgcaccaccaguggaugacgaccgaggacaugcugaccguguggaaccgcguguggaucgaggacaaccccuggauggaggacaagacccccgucacgaccugggaggacgugcccuaccugggcaagcgggaggaccaguggugcgggucccucaucggccugaccagccgcgccaccugggcccagaacauccugacggccauccagcagguccggucccucaucggggacgaggaguuccuggacuacaugccgagcaugaagcgcuuccggaaggaggaggaguccgagggcgccaucugguga

SEQ ID NO: 9929 - RNA, 9873 nt, Artificial Sequence
  derived and/or modified CDS sequence (opt1) from DENV-3__GU131906__SS-prME
accagccugugccucaugaugaugcugcccgccacccuggccuuccaccucaccagccgggacggggagccccggaugaucguggggaagaacgagcggggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacacguggaccgagcaguacaaguuccaggccgacagccccaagcgccuggcgaccgccaucgccggcgccugggagaacggggugugcggcauccgcuccaccacgcggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacagcuggaagacgugggggaaggcgaagaucgugaccgccgagacccagaacuccagcuucaucaucgacggccccaacacccccgagugccccuccgccagccgggccuggaacgugugggaggucgaggacuacggguucggcguguucacgaccaacaucuggcugaagcuccgcgagguguacacccagagcugcgaccaccggcugauguccgcggccaucaaggacgagcgcgccguccacgccgacaugggcuacuggaucgagagccagaagaacggguccuggaagcuggagaaggccagcuucaucgaggugaagaccugcaccuggccgaagucccacacgcucuggagcaacggcgugcuggaguccgacaugaucauccccaagagccuggcggggcccaucucccagcacaaccaccggccgggcuaccacacccagaccgccgggcccuggcaccucggcaagcuggagcuggacuucaacuacugcgagggcaccacggucgugaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucaacgagaaggaggagaacauggucaagucccuggugagcgccggcuccgggaagguggacaacuucaccaugggcguccugugccucgccauccuguucgaggaggugaugcgggggaaguucggcaagaagcacaugaucgccggggugcuguucacguucguccuccugcugagcggccagaucaccuggcgcgacauggcgcacacccucaucaugaucggcuccaacgccagcgaccggauggggaugggcgugaccuaccuggcccugaucgccacguucaagauccagcccuuccucgcccugggguucuuccugcgcaagcucaccagccgggagaaccugcugcucggcgugggccuggcgauggccaccacccugcagcuccccgaggacaucgagcagauggccaacgggaucgcccugggccugaugacgcucaagcugaucacccaguucgagaccuaccagcuguggaccgcgcucgucucccugacgugcagcaacaccaucuucacccugaccguggccuggcgcacggccacccucauccuggccggggucucccugcucccgcugugccagagcuccagcaugcggaagaccgacuggcugcccaugaccguggccgcgaugggcgugccgccccugccgcuguucaucuucucccugaaggacacgccccgccgccggagcuggccccucaacgagggggucauggccgugggccugguguccauccuggccagcucccuccugcgcaacgacguccccauggccggcccgcugguggccgggggccuccugaucgcgugcuacgugaucaccgggaccagcgccgaccugaccgucgagaaggccgccgacgugacgugggaggaggaggccgagcagaccggcgugucccacaaccucaugaucaccgucgacgacgacgggaccaugcggaucaaggacgacgagaccgagaacauccugacggugcugcucaagaccgcgcugcugaucgugagcggcaucuuccccuacuccauccccgccacccuccuggucuggcacaccuggcagaagcagacgcagcgcagcggcgugcugugggacgugcccuccccgcccgagacccagaaggccgagcucgaggagggggucuaccggaucaagcagcagggcaucuucgggaagacccaggugggcguggggguccagaaggagggcguguuccacaccauguggcacgugacgcgcggcgccguccugacccacaacgggaagcggcuggagcccaacugggccagcgugaagaaggaccucaucuccuacggcgggggcuggcgccugagcgcgcaguggcagaagggggaggaggugcaggucaucgccguggagcccggcaagaacccgaagaacuuccagaccaugcccggcaucuuccagaccacgaccggggagaucggcgccaucgcccuggacuucaagcccgggaccagcggcuccccgaucaucaaccgggagggcaagguggucgggcuguacggcaacgggguggugaccaagaacggcggguacgucagcggcaucgcgcagacgaacgccgagcccgacggccccacccccgagcucgaggaggagauguucaagaagcgcaaccugaccaucauggaccugcacccgggguccggcaagacccggaaguaccuccccgccaucgugcgcgaggccaucaagcggcgccugcggacgcugauccucgcccccacccgcguggucgcggccgagauggaggaggcccugaaggggcugcccauccgguaccagaccaccgccaccaagagcgagcacaccggccgcgagaucguggaccucaugugccacgccaccuucaccaugcggcugcuguccccggugcgcguccccaacuacaaccucgugaucauggacgaggcgcacuucacggaccccgccagcaucgccgcccggggguacaucuccacccgcgugggcaugggcgaggccgcggccaucuucaugaccgccacgccgcccgggacggccgaggcguucccccagagcaacgcccccauccaggacgaggagcgcgacauccccgagcgguccuggaacagcggcaacgaguggaucaccgacuucgucgggaagaccgugugguucgugcccuccaucaaggccggcaacgacaucgccaacugccugcgcaagaacgggaagaaggucauccagcugagccggaagaccuucgacacggaguaccagaagacccgccucaacgacugggacuucguggugaccaccgacaucuccgagaugggcgccaacuucaaggcggaccgggucaucgacccccgccggugccugaagcccgugauccugacggacggccccgagcgcgugauccucgccgggccgaugcccgucaccgccgccagcgccgcgcagcggcgcggccggguggggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgccgcgaucgacggcgaguaccgccugaagggcgagagccggaagacguucgucgagcucaugcgccgcggggaccugcccguguggcuggcccacaagguggccuccgagggcaucaaguacaccgaccgcaaguggugcuucgacggggagcggaacaaccagauccucgaggagaacauggacgucgagaucuggaccaaggagggcgagcgcaagaagcugcgcccgcgguggcuggacgcccgcaccuacagcgacccccucgcgcugaaggaguucaaggacuucgccgccggccggaaguccaucgcccuggaccucgugacggagaucgggcgcgugcccagccaccuggcccaccggacccgcaacgcgcuggacaaccucgucaugcugcacaccagcgagcacggcgggcgggccuaccgccacgccguggaggagcugccggagaccauggagacgcuccugcugcucggccugaugauccugcucaccgggggcgccaugcuguuccugaucuccggcaaggggaucggcaagaccagcaucgggcucaucugcgugaucgccuccagcggcaugcuguggauggcggacgucccccugcaguggaucgccuccgccaucgugcucgaguucuucaugauggugcugcugauccccgagcccgagaagcagcggaccccgcaggacaaccagcucgccuacgucgugaucgggauccugacgcuggccgcgaucguggccgccaacgagaugggccuccuggagaccaccaagcgcgaccugggcaugagcaaggagcccggggucgugucccccaccagcuaccucgacguggaccugcaccccgccuccgccuggacgcuguacgcggucgccaccaccgugaucaccccgaugcuccggcacacgaucgagaacagcaccgccaacgugucccuggccgcgaucgccaaccaggccgucgugcugaugggccucgacaagggguggcccaucagcaagauggaccugggcgugccccugcucgcccuggggugcuacucccaggucaacccccugacccucaccgccgcggugcugcugcucgugacgcacuacgccaucaucggcccgggccugcaggccaaggccacccgcgaggcccagaagcggaccgcggccgggaucaugaagaaccccaccgucgacggcaucaugacgaucgaccuggaccccgugaucuacgacagcaaguucgagaagcagcucggccaggugaugcugcugguccucugcgccgugcagcugcugcucaugcgcaccuccugggcccugugcgaggcccugacccucgcgaccggccccaucacgacccugugggagggcagcccggggaaguucuggaacaccaccaucgccguguccauggccaacaucuuccggggcagcuaccuggccggggcgggccucgccuucuccaucaugaaguccgucgggacgggccgccggggcaccgggagccagggcgagacccugggggagaaguggaagaagaagcugaaccagcucucccgcaaggaguucgaccuguacaagaaguccggcaucaccgagguggaccggaccgaggccaaggaggggcugaagcgcggcgagacgacccaccacgccgugucccggggcagcgccaagcuccagugguucgucgagcgcaacauggugauccccgaggggcgcgugaucgaccugggcugcgggcggggcgggugguccuacuacugcgcgggccugaagaaggucaccgaggugcgcggcuacaccaagggcgggcccgggcacgaggagcccgugccgaugagcacguacggcuggaacaucgucaagcucauguccgggaaggacguguucuaccugccgcccgagaagugcgacacccugcugugcgacaucggcgagagcucccccagcccgaccguggaggagucccggaccauccgcguccucaagaugguggagcccuggcugcggaacaaccaguucugcaucaaggugcugaaccccuacaugcccacggucaucgagcaccucgagcgccugcagcggaaguacggcgggaugcuggugcgcaacccgcucagccggaacuccacccacgagauguacuggaucagcaacggcaccgggaacaucguguccagcgucaacauggugucccgccugcugcucaaccgguucaccaugacgcaccgccggcccaccaucgagaaggacgucgaccugggcgccggcacccgccacgugaacgccgagcccgagaccccgaacauggacgugaucggggagcggaucaagcgcaucaaggaggagcacagcuccacguggcacuacgacgacgagaaccccuacaagaccugggccuaccacggcagcuacgaggucaaggccaccgggagcgcguccagcaugaucaacggcguggugaagcugcucaccaagcccugggacgucgugcccauggugacgcagauggccaugaccgacaccaccccguucgggcagcagcgggucuucaaggagaagguggacacgcgcacgccccggcccaugcccggcacccgcaaggugauggagaucaccgccgaguggcuguggcgcacgcugggccggaacaagaagccgcgccucugcacccgggaggaguucaccaagaagguccgcaccaacgccgccaugggggcgguguucacggaggagaaccagugggacuccgcccgggccgccguggaggacgaggaguucuggaagcuggucgaccgcgagcgggagcugcacaagcucggcaagugcgggagcugcguguacaacaugaugggcaagcgcgagaagaagcugggggaguucggcaaggcgaagggcucccgggccaucugguacauguggcugggggcccgcuaccucgaguucgaggcccugggcuuccugaacgaggaccacugguucagccgggagaacuccuacagcgggguggagggcgaggggcuccacaagcugggcuacauccugcgcgacaucuccaagauccccggcggggccauguacgcggacgacaccgccggcugggacacccggaucaccgaggacgaccuccacaacgaggagaagaucacgcagcagauggaccccgagcaccgccagcuggccaacgccaucuucaagcugaccuaccagaacaaggucgugaaggugcagcggcccaccccgaaggggaccgucauggacaucaucagccgcaaggaccagcggggcuccggccagguggggaccuacggccucaacacguucaccaacauggaggcccagcuggugcgccagauggagggggagggcguccugagcaaggcggaccucgagaacccccaccuccuggggaagaagaucacccaguggcucgagaccaagggcguggagcggcugaagcgcauggccaucuccggcgacgacugcguggucaagcccaucgacgaccgguucgccaacgcccugcucgcccugaacgacauggggaaggugcgcaaggacaucccccaguggcagccgagcaagggcuggcacgacuggcagcagguccccuucugcucccaccacuuccacgagcugaucaugaaggacgggcgcaagcucgucgugcccugccggccccaggacgagcugaucggccgcgcgcggaucagccagggggccggcuggucccugaaggagacggccugccucggcaaggccuacgcccagauguggagccugauguacuuccaccgccgggaccugcgccucgcguccaacgccaucugcagcgccgugccgguccacuggauccccaccagccggaccaccugguccauccacgcccaccaccaguggaugacgaccgaggacaugcugaccguguggaaccgcguguggaucgaggacaaccccuggauggaggacaagacccccgucacgaccugggaggacgugccguaccuggggaagcgggaggaccaguggugcggcagccucaucgggcugaccucccgcgcgaccugggcccagaacauccugacggccauccagcagguccggagccucaucggcgacgaggaguuccuggacuacaugcccuccaugaagcgcuuccggaaggaggaggagagcgagggggccaucugguga

SEQ ID NO: 9930 - RNA, 9873 nt, Artificial Sequence
  derived and/or modified CDS sequence (opt1) from DENV-3__GU131907__SS-prME
accagccugugccucaugaugaugcugcccgcgacccuggccuuccaccucaccagccgcgacggcgagccgcggaugaucguggggaagaacgagcgcggcaagagccugcuguucaagaccgcguccgggaucaacaugugcacccucaucgccauggaccugggcgagaugugcgacgacaccgucaccuacaagugcccccugaucgccgagguggagcccgaggacaucgacugcuggugcaaccucaccagcaccugggugaccuacgggaccugcaaccaggccggcgagcaccggcgcgacaagcgguccgucgcccuggcgccccacgugggcauggggcuggacacccgcacccagaccuggaugagcgccgagggcgccuggcgccagguggagaaggucgagaccugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcaacgggaucuucgucaccaacgaggugcacacguggaccgagcaguacaaguuccaggccgacucccccaagcgccuggcgaccgccaucgccggcgccugggagaacggggugugcggcauccgcagcaccacgcggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacuccuggaagacgugggggaaggcgaagaucgugaccgccgagacccagaacagcuccuucaucaucgacggccccaacacccccgagugccccagcgccucccgggccuggaacgugugggaggucgaggacuacggguucggcguguucacgaccaacaucuggcugaagcuccgcgagguguacacccagagcugcgaccaccggcugaugagcgcggccaucaaggacgagcgcgccguccacgccgacaugggcuacuggaucgagucccagaagaacgggagcuggaagcuggagaaggccuccuucaucgaggugaagaccugcaccuggcccaagagccacacgcucugguccaacggcgugcuggagagcgacaugaucauccccaagucccuggcggggcccaucagccagcacaaccaccggccgggcuaccacacccagaccgccgggcccuggcaccucggcaagcuggagcuggacuucaacuacugcgagggcaccacggucgugaucgccgagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgcgggggugcuguucaccuucguccuccugcuguccggccagaucacguggcgcgacauggcccacacccucaucaugaucggcagcaacgccuccgaccggauggggaugggcgugaccuaccuggcccugaccgccacguucaagauccagcccuuccucgcgcugggguucuuccugcgcaagcucaccagccgggagaaccugcugcucggcgugggccuggccauggccaccacccugcagcuccccgaggacaucgagcagauggccaacgggaucgcgcugggccugaugacgcucaagcugaucacccaguucgagaccuaccagcuguggaccgcccucgucagccugacgugcuccaacaccaucuucacccugaccguggccuggcgcacggccacccucauccuggccggggucagccugcucccgcugugccaguccagcuccaugcggaagaccgacuggcugcccaugaccguggcggccaugggcgugccgccccugccgcuguucaucuucagccugaaggacacgcccaagcgccgcuccuggccccucaacgagggggucauggccgugggccuggugagcauccuggccuccagccuccugcggaacgacguccccauggccggcccgcugguggccggcgggcuccugaucgccugcuacgugaucaccgggaccuccgccgaccugaccgucgagaaggccgccgacgugacgugggaggaggaggcggagcagaccggggugagccacaaccucaugaucaccgucgacgacgacgggaccaugcgcaucaaggacgacgagaccgagaacauccugacggugcugcucaagaccgcccugcugaucguguccggcaucuuccccuacagcauccccgccacccuccuggucuggcacaccuggcagaagcagacgcagcgguccggcgugcugugggacgugcccagcccgcccgagacccagaaggccgagcucgaggagggggucuaccgcaucaagcagcagggcaucuucgggaagacccaggugggcguggggguccagaaggagggcguguuccacaccauguggcacgugacgcggggcgccguccugacccacaacgggaagcgccuggagcccaacugggcguccgugaagaaggaccucaucagcuacggcgggggcuggcggcuguccgcccaguggcagaagggggaggaggugcaggucaucgccguggagcccggcaagaacccgaagaacuuccagaccaugcccggcaucuuccagaccacgaccggggagaucggcgccaucgcgcuggacuucaagcccgggaccagcggcagcccgaucaucaaccgcgagggcaagguggucgggcuguacggcaacgggguggugaccaagaacggcggguacgucuccggcaucgcccagacgaacgccgagcccgacggccccacccccgagcucgaggaggagauguucaagaagcggaaccugaccaucauggaccugcacccggggagcggcaagacccgcaaguaccuccccgccaucgugcgggaggccaucaagcgccggcugcgcacgcugauccucgcgcccacccggguggucgccgccgagauggaggaggcccugaaggggcugcccauccgcuaccagaccaccgccacgaaguccgagcacaccggccgggagaucguggaccucaugugccacgcgaccuucaccaugcgccugcugagcccggugcggguccccaacuacaaccucgugaucauggacgaggcccacuucacggaccccgccuccaucgccgcccgcggguacaucagcacccgggugggcaugggcgaggcggccgccaucuucaugaccgccacgccgcccgggacggcggaggccuucccccaguccaacgcccccauccaggacgaggagcgcgacauccccgagcgcagcuggaacuccggcaacgaguggaucaccgacuucgucgggaagaccgugugguucgugcccagcaucaaggccggcaacgacaucgccaacugccugcggaagaacgggaagaaggucauccagcugucccgcaagaccuucgacacggaguaccagaagacccggcucaacgacugggacuucguggugaccaccgacaucagcgagaugggcgcgaacuucaaggccgaccgcgucaucgacccccggcgcugccugaagcccgugauccugacggacggccccgagcgggugauccucgccgggccgaugcccgucaccgccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagacguucgucgagcucaugcggcgcggggaccugcccguguggcuggcccacaagguggccagcgagggcaucaaguacaccgaccggaaguggugcuucgacggggagcgcaacaaccagauccucgaggagaacauggacgucgagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugacggagaucgggcgggugcccucccaccuggcgcaccgcacccggaacgcccuggacaaccucgucaugcugcacaccagcgagcacggcgggcgcgccuaccggcacgccguggaggagcugccggagaccauggagacgcuccugcugcucggccugaugauccugcucaccgggggcgccaugcuguuccugaucagcggcaaggggaucggcaagaccuccaucgggcucaucugcgugaucgucagcuccggcaugcuguggauggcggacgugccccugcaguggaucgccagcgccaucgugcucgaguucuucaugaugguccugcugauccccgagcccgagaagcagcgcaccccgcaggacaaccagcucgccuacguggugaucgggauccugacgcuggccgcgaucgucgccgccaacgagaugggccuccuggagaccaccaagcgggaccugggcauguccaaggagcccgggguggugagccccaccuccuaccucgacgucgaccugcaccccgccagcgccuggacgcuguacgcgguggccaccaccgugaucaccccgaugcuccgccacacgaucgagaacuccaccgccaacgucagccuggccgcgaucgccaaccaggccguggugcugaugggccucgacaagggguggcccaucuccaagauggaccugggcgucccccugcucgcccuggggugcuacagccaggugaacccccugacccucaccgccgcggugcugcugcucgucacgcacuacgccaucaucggcccgggccugcaggccaaggccacccgggaggcccagaagcgcaccgcggccgggaucaugaagaaccccaccguggacggcaucaugacgaucgaccuggaccccgugaucuacgacuccaaguucgagaagcagcucgggcaggucaugcugcuggugcucugcgccgugcagcugcugcucaugcggaccagcugggcccugugcgaggcccugacccucgcgaccggccccaucacgacccugugggagggcuccccggggaaguucuggaacaccaccaucgccgucagcauggccaacaucuuccgcggcuccuaccuggccggggcgggccucgccuucagcaucaugaaguccguggggacgggccggcgcggcaccgggagccagggcgagacccugggggagaaguggaagaagaagcugaaccagcucagccggaaggaguucgaccuguacaagaaguccggcaucaccgagguggaccgcaccgaggccaaggaggggcugaagcggggcgagacgacccaccacgccgucagccgcggcuccgccaagcuccagugguucguggagcggaacauggugauccccgaggggcgcgucaucgaccugggcugcgggcgcggcggguggagcuacuacugcgcgggccugaagaaggugaccgaggugcggggcuacaccaagggcggccccgggcacgaggagcccgucccgauguccacguacggcuggaacaucgugaagcucaugagcgggaaggacguguucuaccugccgcccgagaagugcgacacccugcugugcgacaucggcgaguccagccccuccccgaccgucgaggagagccgcaccauccgggugcucaagaugguggagcccuggcugcgcaacaaccaguucugcaucaagguccugaaccccuacaugcccacggugaucgagcaccucgagcggcugcagcgcaaguacggcgggaugcuggugcggaacccgcucucccgcaacagcacccacgagauguacuggaucuccaacggcaccgggaacaucgucagcuccgugaacauggucagccggcugcugcucaaccgcuucaccaugacgcaccggcgccccaccaucgagaaggacguggaccugggcgccggcacccggcacgugaacgccgagcccgagaccccgaacauggacgucaucggggagcgcaucaagcggaucaaggaggagcacuccagcacguggcacuacgacgacgagaaccccuacaagaccugggccuaccacggcuccuacgaggugaaggccaccgggagcgcgagcuccaugaucaacggcguggucaagcugcucaccaagcccugggacguggugcccauggucacgcagauggccaugaccgacaccaccccguucgggcagcagcgcguguucaaggagaagguggacacgcggacgccccggcccaugcccggcacccggaaggucauggagaucaccgccgaguggcuguggcgcacgcugggccgcaacaagaagccgcggcucugcacccgcgaggaguucaccaagaaggugcggaccaacgccgccaugggggcgguguucacggaggagaaccagugggacagcgcccgcgccgccgucgaggacgaggaguucuggaagcugguggacaaggagcgggagcugcacaagcucggcaagugcggguccugcguguacaacaugaugggcaagcgcgagaagaagcugggggaguucggcaaggcgaagggcagccgggccaucugguacauguggcugggggcccgcuaccucgaguucgaggcccugggcuuccugaacgaggaccacugguucucccgggagaacagcuacuccggggucgagggcgaggggcuccacaagcugggcuacauccugcgcgacaucagcaagauccccggcggggccauguacgcggacgacaccgccggcugggacacccggaucaccgaggacgaccuccacaacgaggagaagaucacgcagcagauggaccccgagcaccgccagcuggccaacgccaucuucaagcugaccuaccagaacaagguggugaagguccagcggcccaccccgaaggggaccgugauggacaucaucucccgcaaggaccagcggggcagcggccagguggggaccuacggccucaacacguucaccaacauggaggcccagcugguccgccagauggagggggagggcgugcuguccaaggcggaccucgagaacccccaccuccuggagaagaagaucacccaguggcucgagaccaaggggguggagcggcugaagcgcauggccaucagcggcgacgacugcgucgugaagcccaucgacgaccgguucgccaacgcccugcucgcccugaacgacaugggcaaggugcgcaaggacaucccccaguggcagccguccaagggguggcacgacuggcagcagguccccuucugcagccaccacuuccacgagcugaucaugaaggacggccggaagcucguggugcccugccgcccccaggacgagcugaucgggcgcgcgcggaucucccagggcgccggguggagccugaaggagacggccugccucggcaaggccuacgcccagauguggucccugauguacuuccaccgccgggaccugcgccucgcgagcaacgccaucugcuccgccgucccggugcacuggauccccaccagccggaccaccuggagcauccacgcccaccaccaguggaugacgaccgaggacaugcugaccguguggaaccgcgucuggaucgaggacaaccccuggauggaggacaagacccccgugacgaccugggaggacgugccguaccugggcaagcgggaggaccaguggugcgggucccucaucggccugaccagccgcgcgaccugggcccagaacauccugacggccauccagcagguccggucccucaucggggacgaggaguuccuggacuacaugcccagcaugaagcgcuuccggaaggaggaggagaccgagggcgccaucugguga

SEQ ID NO: 9931 - RNA, 9873 nt, Artificial Sequence
  derived and/or modified CDS sequence (opt1) from DENV-3__GQ868634__SS-prME
accagccugugccucaugaugaugcugcccgcgacccuggccuuccaccucaccagccgcgacggcgagccccggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaagguggagaccugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgccaucaacuggaagggcaaggagcugaagugcggcuccgggaucuucgugaccaacgagguccacacguggaccgagcaguacaaguuccaggcggacagccccaagcgccuggccaccgccaucgccggcgccugggagaacggggugugcggcauccgcuccaccacgcggauggagaaccuccuguggaagcagaucgcgaacgagcugaacuacauccucugggagaacaacaucaagcugaccguggucgugggggacaucaucggcgugcuggagcagggcaagcgcacccucacgccccagccgauggagcugaaguacagcuggaagacgugggggaaggccaagaucgucaccgccgagacccagaacuccagcuucaucaucgacggccccaacacccccgagugccccuccgccagccgggcguggaacgugugggagguggaggacuacggguucggcgucuucacgaccaacaucuggcugaagcuccgcgagguguacacccagagcugcgaccaccggcugauguccgccgccaucaaggacgagcgcgccgugcacgccgacaugggcuacuggaucgagagccagaagaacggguccuggaagcuggagaaggcgagcuucaucgaggucaagaccugcaccuggccgaagucccacacgcucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcaccacgguggucaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucaacgagaaggaggagaacauggugaagucccuggucagcgccggcuccgggaagguggacaacuucaccaugggcgugcugugccucgccauccuguucgaggaggucaugcgggggaaguucggcaagaagcacaugaucgcgggggugcuguucacguucgugcuccugcugagcggccagaucaccuggcgcgacauggcccacacccucaucaugaucggcuccaacgccagcgaccggauggggaugggcgucaccuaccuggcccugaucgccacguucaagauccagcccuuccucgcgcugggguucuuccugcgcaagcucaccagccgggagaaccugcugcucggcgugggccuggccauggccaccacccugcagcuccccgaggacaucgagcagauggccaacgggaucgcgcugggccugaugacgcucaagcugaucacccaguucgagaccuaccagcuguggaccgcccucgugucccugacgugcagcaacaccaucuucacccugaccgucgccuggcgcacggccacccucauccuggccggggugucccugcucccgcugugccagagcuccagcaugcggaagaccgacuggcugcccaugaccgucgcggccaugggcgugccgccccugccgcuguucaucuucucccugaaggacacgcccaagcgccgcagcuggccccucaacgagggggugauggccgucggccugguguccauccuggccagcucccuccugcggaacgacgugcccauggccggcccgcuggucgccggcgggcuccugaucgccugcuacgugaucaccgggaccagcgccgaccugaccguggagaaggccgccgacgucacgugggaggaggaggcggagcagaccggggugucccacaaccucaugaucaccguggacgacgacgggaccaugcgcaucaaggacgacgagaccgagaacauccugacgguccugcucaagaccgcccugcugaucgugagcggcaucuuccccuacuccauccccgccacccuccugguguggcacaccuggcagaagcagacgcagcggagcggcguccugugggacgugcccuccccgcccgagacccagaaggccgagcucgaggaggggguguaccgcaucaagcagcagggcaucuucgggaagacccaggucggcgugggggugcagaaggagggcgucuuccacaccauguggcacgugacgcggggcgccgugcugacccacaacgggaagcgccuggagcccaacugggcgagcgucaagaaggaccucaucuccuacggcgggggcuggcggcugaacgcccaguggcagaagggggaggagguccaggugaucgccgucgagcccggcaagaacccgaagaacuuccagaccaugcccggcaucuuccagaccacgaccggggagaucggcgccaucgcgcuggacuucaagcccgggaccagcggcagcccgaucaucaaccgcgagggcaaggugguggggcuguacggcaacggggucgugaccaagaacggcggguacguguccggcaucgcccagacgaacgccgagcccgacggccccacccccgagcucgaggaggagauguucaagaagcggaaccugaccaucauggaccugcacccggggagcggcaagacccgcaaguaccuccccgccaucguccgggaggccaucaagcgccggcugcgcacgcugauccucgcgcccacccgggugguggccgccgagauggaggaggcccugaaggggcugcccauccgcuaccagaccaccgccacgaaguccgagcacaccggccgggagaucgucgaccucaugugccacgcgaccuucaccaugcgccugcugagcccggugcgggugcccaacuacaaccucgucaucauggacgaggcccacuucacggaccccgccuccaucgccgcccgcggguacaucagcacccgggugggcaugggcgaggcggccgccaucuucaugaccgccacgccgcccgggacggcggaggccuucccccaguccaacgcccccauccaggacgaggagcgcgacauccccgagcgcagcuggaacuccggcaacgaguggaucaccgacuucguggggaagaccgucugguucgugcccagcaucaaggccggcaacgacaucgccaacugccugcggaagaacgggaagaaggugauccagcugucccgcaagaccuucgacacggaguaccagaagacccggcucaacgacugggacuucgucgugaccaccgacaucagcgagaugggcgcgaacuucaaggccgaccgcgugaucgacccccggcgcugccugaagcccgucauccugacggacggccccgagcgggugauccucgccgggccgaugcccgugaccgccgccuccgcggcccagcgccggggccgcgucgggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagacguucguggagcucaugcggcgcggggaccugcccgucuggcuggcccacaagguggccagcgagggcaucaaguacaccgaccggaaguggugcuucgacggggagcgcaacaaccagauccucgaggagaacauggacguggagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgucacggagaucgggcgggugcccucccaccuggcgcaccgcacccggaacgcccuggacaaccucgugaugcugcacaccagcgagcacggcgggcgcgccuaccggcacgccgucgaggagcugccggagaccauggagacgcuccugcugcucggccugaugauccugcucaccgggggcgccaugcuguuccugaucagcggcaaggggaucggcaagaccuccaucgggcucaucugcgugaucgugagcuccggcaugcuguggauggcggacgucccccugcaguggaucgccagcgccaucgugcucgaguucuucaugauggugcugcugauccccgagcccgagaagcagcgcaccccgcaggacaaccagcucgccuacgucgugaucgggauccugacgcuggccgcgaucguggccgccaacgagaugggccuccuggagaccaccaagcgggaccugggcauguccaaggagcccggggucgugagccccaccuccuaccucgacguggaccugcaccccgccagcgccuggacgcuguacgcggucgccaccaccgugaucaccccgaugcuccgccacacgaucgagaacuccaccgccaacgugagccuggccgcgaucgccaaccaggccgucgugcugaugggccucgacaagggguggcccaucuccaagauggaccugggcgugccccugcucgcccuggggugcuacagccaggucaacccccugacccucaccgccgcggugcugcugcucgugacgcacuacgccaucaucggcccgggccugcaggccaaggccacccgggaggcccagaagcgcaccgcggccgggaucaugaagaaccccaccgucgacggcaucaugacgaucgaccuggaccccgugaucuacgacuccaaguucgagaagcagcucggccaggugaugcugcugguccucugcgccgugcagcugcugcucaugcggaccagcugggcccugugcgaggcccugacccucgcgaccggccccaucacgacccugugggagggcuccccggggaaguucuggaacaccaccaucgccgugagcauggccaacaucuuccgcggcuccuaccuggccggggcgggccucgccuucagcaucaugaaguccgucgggacgggccggcgcggcaccgggagccagggcgagacccugggggagaaguggaagaagaagcugaaccagcucagccggaaggaguucgaccuguacaagaaguccggcaucaccgagguggaccgcaccgaggccaaggaggggcugaagcggggcgagacgacccaccacgccgugagccgcggcuccgccaagcuccagugguucgucgagcggaacauggugauccccgaggggcgcgugaucgaccugggcugcgggcgcggcggguggagcuacuacugcgcgggccugaagaaggucaccgaggugcggggcuacaccaagggcgggcccgggcacgaggagcccgugccgauguccacguacggcuggaacaucgucaagcucaugagcgggaaggacguguucuaccugccgcccgagaagugcgacacccugcugugcgacaucggcgaguccagccccuccccgaccguggaggagagccgcaccauccggguccucaagaugguggagcccuggcugcgcaacaaccaguucugcaucaaggugcugaaccccuacaugcccacggucaucgagcaccucgagcggcugcagcgcaaguacggcgggaugcuggugcggaacccgcucucccgcaacagcacccacgagauguacuggaucuccaacggcaccgggaacaucgugagcuccgucaacauggugagccggcugcugcucaaccgcuucaccaugacgcaccggcgccccaccaucgagaaggacgucgaccugggcgccggcacccggcacgugaacgccgagcccgagaccccgaacauggacgugaucggggagcgcaucaagcggaucaaggaggagcacuccagcacguggcacuacgacgacgagaaccccuacaagaccugggccuaccacggcuccuacgaggucaaggccaccgggagcgcgagcuccaugaucaacggcguggugaagcugcucaccaagcccugggacgucgugcccauggugacgcagauggccaugaccgacaccaccccguucgggcagcagcgcgucuucaaggagaagguggacacgcggacgccccggcccaugcccggcacccggaaggugauggagaucaccgccgaguggcuguggcgcacgcugggccgcaacaagaagccgcggcucugcacccgcgaggaguucaccaagaagguccggaccaacgccgccaugggggcgguguucacggaggagaaccagugggacagcgcccgcgccgccguggaggacgaggaguucuggaagcuggucgaccgggagcgcgagcugcacaagcucggcaagugcggguccugcguguacaacaugaugggcaagcgggagaagaagcugggggaguucggcaaggcgaagggcagccgcgccaucugguacauguggcugggggcccgguaccucgaguucgaggcccugggcuuccugaacgaggaccacugguucucccgcgagaacagcuacuccgggguggagggcgaggggcuccacaagcugggcuacauccugcgggacaucagcaagauccccggcggggccauguacgcggacgacaccgccggcugggacacccgcaucaccgaggacgaccuccacaacgaggagaagaucacgcagcagauggaccccgagcaccggcagcuggccaacgccaucuucaagcugaccuaccagaacaaggucgugaaggugcagcgccccaccccgaaggggaccgucauggacaucaucucccggaaggaccagcgcggcagcggccagguggggaccuacggccucaacacguucaccaacauggaggcccagcuggugcggcagauggagggggagggcguccuguccaaggcggaccucgagaacccccaccuccuggagaagaagaucacccaguggcucgagaccaaggggguggagcgccugaagcggauggccaucagcggcgacgacugcguggucaagcccaucgacgaccgcuucgccaacgcccugcucgcccugaacgacaugggcaaggugcggaaggacaucccccaguggcagccguccaagggguggcacgacuggcagcagguccccuucugcagccaccacuuccacgagcugaucaugaaggacggccgcaagcucgucgugcccugccgcccccaggacgagcugaucgggcgggcgcgcaucucccagggcgccggguggagccugaaggagacggccugccucggcaaggccuacgcccagauguggucccugauguacuuccaccggcgcgaccugcggcucgcgagcaacgccaucugcuccgccgugccgguccacuggauccccaccagccgcaccaccuggagcauccacgcccaccaccaguggaugacgaccgaggacaugcugaccguguggaaccggguguggaucgaggacaaccccuggauggaggacaagacccccgucacgaccugggaggacgugccguaccugggcaagcgcgaggaccaguggugcgggucccucaucggccugaccagccgggcgaccugggcccagaacauccugacggccauccagcagguccgcucccucaucggggacgaggaguuccuggacuacaugcccagcaugaagcgguuccgcaaggaggaggaguccgagggcgccaucugguga

SEQ ID NO: 9932 - RNA, 9873 nt, Artificial Sequence
  derived and/or modified CDS sequence (opt1) from DENV-3__GU131908__SS-prME
accagccugugccucaugaugaugcugcccgcgacccuggccuuccaccucaccagccgcgacggcgagccccggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaagguggagaccugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgccaucaacuggaagggcaaggagcugaagugcggcuccgggaucuucgugaccaacgagguccacacguggaccgagcaguacaaguuccaggcggacagccccaagcgccuggccaccgccaucgccggcgccuggaagaacggggugugcggcauccgcuccaccacgcggauggagaaccuccuguggaagcagaucgcgaacgagcugaacuacauccucugggagaacaacaucaagcugaccguggucgugggggacaucaucggcgugcuggagcagggcaagcgcacccucacgccccagccgauggagcugaaguacagcuggaagacgugggggaaggccaagaucgucaccgccgagacccagaacuccagcuucaucaucgacggccccaacacccccgagugccccuccgccagccgggcguggaacgugugggagguggaggacuacggguucggcgucuucacgaccaacaucuggcugaagcuccgcgagguguacacccagagcugcgaccaccggcugauguccgccgccaucaaggacgagcgcgccgugcacgccgacaugggcuacuggaucgagagccagaagaacggguccuggaagcuggagaaggcgagcuucaucgaggucaagaccugcaccuggccgaagucccacacgcucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcaccacgguggucaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucaacgagaaggaggagaacauggugaagucccuggucagcgccggcuccgggaagguggacaacuucaccaugggcgugcugugccucgccauccuguucgaggaggucaugcgggggaaguucggcaagaagcacaugaucgcgggggugcuguucacguucgugcuccugcugagcggccagaucaccuggcgcgacauggcccacacccucaucaugaucggcuccaacgccagcgaccggauggggaugggcgucaccuaccuggcccugaucgccacguucaagauccagcccuuccucgcgcugggguucuuccugcgcaagcucaccagccgggagaaccugcugcucggcgugggccuggccauggccaccacccugcagcuccccgaggacaucgagcagauggccaacgggaucgcgcugggccugaugacgcucaagcugaucacccaguucgagaccuaccagcuguggaccgcccucgugucccugacgugcagcaacaccaucuucacccugaccgucgccuggcgcacggccacccucauccuggccggggugucccugcucccgcugugccagagcuccagcaugcggaagaccgacuggcugcccaugaccgucgcggccaugggcgugccgccccugccgcuguucaucuucucccugaaggacacgcccaagcgccgcagcuggccccucaacgagggggugauggccgucggccugguguccauccuggccagcucccuccugcggaacgacgugcccauggccggcccgcuggucgccggcgggcuccugaucgccugcuacgugaucaccgggaccagcgccgaccugaccguggagaaggccgccgacgucacgugggaggaggaggcggagcagaccggggugucccacaaccucaugaucaccguggacgacgacgggaccaugcgcaucaaggacgacgagaccgagaacauccugacgguccugcucaagaccgcccugcugaucgugagcggcaucuuccccuacuccauccccgccacccuccugguguggcacaccuggcagaagcagacgcagcggagcggcguccugugggacgugcccuccccgcccgagacccagaaggccgagcucgaggaggggguguaccgcaucaagcagcagggcaucuucgggaagacccaggucggcgugggggugcagaaggagggcgucuuccacaccauguggcacgugacgcggggcgccgugcugacccacaacgggaagcgccuggagcccaacugggcgagcgucaagaaggaccucaucuccuacggcgggggcuggcggcugaacgcccaguggcagaagggggaggagguccaggugaucgccgucgagcccggcaagaacccgaagaacuuccagaccaugcccggcaucuuccagaccacgaccggggagaucggcgccaucgcgcuggacuucaagcccgggaccagcggcagcccgaucaucaaccgcgagggcaaggugguggggcuguacggcaacggggucgugaccaagaacggcggguacguguccggcaucgcccagacgaacgccgagcccgacggccccacccccgagcucgaggaggagauguucaagaagcggaaccugaccaucauggaccugcacccggggagcggcaagacccgcaaguaccuccccgccaucguccgggaggccaucaagcgccggcugcgcacgcugauccucgcgcccacccgggugguggccgccgagauggaggaggcccugaaggggcugcccauccgcuaccagaccaccgccacgaaguccgagcacaccggccgggagaucgucgaccucaugugccacgcgaccuucaccaugcgccugcugagcccggugcgggugcccaacuacaaccucgucaucauggacgaggcccacuucacggaccccgccuccaucgccgcccgcggguacaucagcacccgggugggcaugggcgaggcggccgccaucuucaugaccgccacgccgcccgggacggcggaggccuucccccaguccaacgcccccauccaggacgaggagcgcgacauccccgagcgcagcuggaacuccggcaacgaguggaucaccgacuucguggggaagaccgucugguucgugcccagcaucaaggccggcaacgacaucgccaacugccugcggaagaacgggaagaaggugauccagcugucccgcaagaccuucgacacggaguaccagaagacccggcucaacgacugggacuucgucgugaccaccgacaucagcgagaugggcgcgaacuucaaggccgaccgcgugaucgacccccggcgcugccugaagcccgucauccugacggacggccccgagcgggugauccucgccgggccgaugcccgugaccgccgccuccgcggcccagcgccggggccgcgucgggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagacguucguggagcucaugcggcgcggggaccugcccgucuggcuggcccacaagguggccagcgagggcaucaaguacaccgaccggaaguggugcuucgacggggagcgcaacaaccagauccucgaggagaacauggacguggagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgucacggagaucgggcgggugcccucccaccuggcgcaccgcacccggaacgcccuggacaaccucgugaugcugcacaccagcgagcacggcgggcgcgccuaccggcacgccgucgaggagcugccggagaccauggagacgcuccugcugcucggccugaugauccugcucaccgggggcgccaugcuguuccugaucagcggcaaggggaucggcaagaccuccaucgggcucaucugcgugaucgugagcuccggcaugcuguggauggcggacgucccccugcaguggaucgccagcgccaucgugcucgaguucuucaugauggugcugcugauccccgagcccgagaagcagcgcaccccgcaggacaaccagcucgccuacgucgugaucgggauccugacgcuggccgcgaucguggccgccaacgagaugggccuccuggagaccaccaagcgggaccugggcauguccaaggagcccggggucgugagccccaccuccuaccucgacguggaccugcaccccgccagcgccuggacgcuguacgcggucgccaccaccgugaucaccccgaugcuccgccacacgaucgagaacuccaccgccaacgugagccuggccgcgaucgccaaccaggccgucgugcugaugggccucgacaagggguggcccaucuccaagauggaccugggcgugccccugcucgcccuggggugcuacagccaggucaacccccugacccucaccgccgcggugcugcugcucgugacgcacuacgccaucaucggcccgggccugcaggccaaggccacccgggaggcccagaagcgcaccgcggccgggaucaugaagaaccccaccgucgacggcaucaugacgaucgaccuggaccccgugaucuacgacuccaaguucgagaagcagcucggccaggugaugcugcugguccucugcgccgugcagcugcugcucaugcggaccagcugggcccugugcgaggcccugacccucgcgaccggccccaucacgacccugugggagggcuccccggggaaguucuggaacaccaccaucgccgugagcauggccaacaucuuccgcggcuccuaccuggccggggcgggccucgccuucagcaucaugaaguccgucgggacgggccggcgcggcaccgggagccagggcgagacccugggggagaaguggaagaagaagcugaaccagcucagccggaaggaguucgaccuguacaagaaguccggcaucaccgagguggaccgcaccgaggccaaggaggggcugaagcggggcgagacgacccaccacgccgugagccgcggcuccgccaagcuccagugguucgucgagcggaacauggugauccccgaggggcgcgugaucgaccugggcugcgggcgcggcggguggagcuacuacugcgcgggccugaagaaggucaccgaggugcggggcuacaccaagggcgggcccgggcacgaggagcccgugccgauguccacguacggcuggaacaucgucaagcucaugagcgggaaggacguguucuaccugccgcccgagaagugcgacacccugcugugcgacaucggcgaguccagccccuccccgaccguggaggagagccgcaccauccggguccucaagaugguggagcccuggcugcgcaacaaccaguucugcaucaaggugcugaaccccuacaugcccacggucaucgagcaccucgagcggcugcagcgcaaguacggcgggaugcuggugcggaacccgcucucccgcaacagcacccacgagauguacuggaucuccaacggcaccgggaacaucgugagcuccgucaacauggugagccggcugcugcucaaccgcuucaccaugacgcaccggcgccccaccaucgagaaggacgucgaccugggcgccggcacccggcacgugaacgccgagcccgagaccccgaacauggacgugaucggggagcgcaucaagcggaucaaggaggagcacuccagcacguggcacuacgacgacgagaaccccuacaagaccugggccuaccacggcuccuacgaggucaaggccaccgggagcgcgagcuccaugaucaacggcguggugaagcugcucaccaagcccugggacgucgugcccauggugacgcagauggccaugaccgacaccaccccguucgggcagcagcgcgucuucaaggagaagguggacacgcggacgccccggcccaugcccggcacccggaaggugauggagaucaccgccgaguggcuguggcgcacgcugggccgcaacaagaagccgcggcucugcacccgcgaggaguucaccaagaagguccggaccaacgccgccaugggggcgguguucacggaggagaaccagugggacagcgcccgcgccgccguggaggacgaggaguucuggaagcuggucgaccgggagcgcgagcugcacaagcucggcaagugcggguccugcguguacaacaugaugggcaagcgggagaagaagcugggggaguucggcaaggcgaagggcagccgcgccaucugguacauguggcugggggcccgguaccucgaguucgaggcccugggcuuccugaacgaggaccacugguucucccgcgagaacagcuacuccgggguggagggcgaggggcuccacaagcugggcuacauccugcgggacaucagcaagauccccggcggggccauguacgcggacgacaccgccggcugggacacccgcaucaccgaggacgaccuccacaacgaggagaagaucacgcagcagauggaccccgagcaccggcagcuggccaacgccaucuucaagcugaccuaccagaacaaggucgugaaggugcagcgccccaccccgaaggggaccgucauggacaucaucucccggaaggaccagcgcggcagcggccagguggggaccuacggccucaacacguucaccaacauggaggcccagcuggugcggcagauggagggggagggcguccuguccaaggcggaccucgagaacccccaccuccuggagaagaagaucacccaguggcucgagaccaaggggguggagcgccugaagcggauggccaucagcggcgacgacugcguggucaagcccaucgacgaccgcuucgccaacgcccugcucgcccugaacgacaugggcaaggugcggaaggacaucccccaguggcagccguccaagggguggcacgacuggcagcagguccccuucugcagccaccacuuccacgagcugaucaugaaggacggccgcaagcucgucgugcccugccgcccccaggacgagcugaucgggcgggcgcgcaucucccagggcgccggguggagccugaaggagacggccugccucggcaaggccuacgcccagauguggucccugauguacuuccaccggcgcgaccugcggcucgcgagcaacgccaucugcuccgccgugccgguccacuggauccccaccagccgcaccaccuggagcauccacgcccaccaccaguggaugacgaccgaggacaugcugaccguguggaaccggguguggaucgaggacaaccccuggauggaggacaagacccccgucacgaccugggaggacgugccguaccugggcaagcgcgaggaccaguggugcgggucccucaucggccugaccagccgggcgaccugggcccagaacauccugacggccauccagcagguccgcucccucaucggggacgaggaguuccuggacuacaugcccagcaugaagcgguuccgcaaggaggaggaguccgagggcgccaucugguga

SEQ ID NO: 9933 - RNA, 9873 nt, Artificial Sequence
  derived and/or modified CDS sequence (opt1) from DENV-3__GU131909__SS-prME
accagccucugccucaugaugaugcugcccgcgacccuggccuuccaccucaccagccgcgacggcgagccgcggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaagguggagaccugggccuuccgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagagcaagcccacccucgacaucgagcugcagaagaccgaggccacccagcuggcgacgcuccggaagcugugcaucgagggcaagaucaccaacaucaccaccgacucccgcugccccacgcagggcgaggccacccugccggaggagcaggaccagaacuacgugugcaagcacaccuacgucgaccggggguggggcaacgggugcggccucuucgggaagggcagccuggugaccugcgccaaguuccagugccuggagcccaucgagggcaaggugguccaguacgagaaccucaaguacacggugaucaucaccgugcacaccggggaccagcaccaggucggcaacgacacccagggggugacggucgagaucacgccccaggccuccaccguggaggccgugcugcccgaguacggcacccuggggcucgagugcagcccgcgcaccggccuggacuucaacgagaugauccugcucacgaugaagaacaaggcguggaugguccaccggcagugguucuucgaccugccccugcccuggaccuccggcgccaccaccgagacgcccaccuggaaccgcaaggagcuccuggugaccuucaagaacgcccacgccaagaagcaggagguggucgugcuggggagccaggagggcgccaugcacaccgcgcucacgggggccaccgagauccagaacuccggcgggaccagcaucuucgccggccaccugaagugccggcugaagauggacaagcucgagcugaagggcauguccuacgccaugugccugaacaccuucgugcucaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccugaagaucaacugguacaagaagggcagcuccaucgggaagauguucgaggcgaccgcccggggcgcccgccggauggccauccucggcgacaccgccugggacuucgggagcgucggcggggugcugaacucccugggcaagauggugcaccagaucuucgggagcgcguacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggccgacauggggugcgccaucaacuggaagggcaaggagcucaagugcggcuccgggaucuucgugaccaacgagguccacacguggaccgagcaguacaaguuccaggcggacagccccaagcgccuggccaccgccaucgccggcgccugggagaacggggugugcggcauccgcuccaccacgcggauggagaaccugcucuggaagcagaucgcgaacgagcugaacuacauccugugggagaacaacaucaagcucaccguggucgugggggacaucaucggcgugcuggagcagggcaagcgcacccugacgccccagccgauggagcucaaguacagcuggaagacgugggggaaggccaagaucgucaccgccgagacccagaacuccagcuucaucaucgacggccccaacacccccgagugccccuccgccagccgggcguggaacgugugggagguggaggacuacggguucggcgucuucacgaccaacaucuggcugaagcugcgcgagguguacacccagagcugcgaccaccggcucauguccgccgccaucaaggacgagcgcgccgugcacgccgacaugggcuacuggaucgagagccagaagaacggguccuggaagcuggagaaggcgagcuucaucgaggucaagaccugcaccuggccgaagucccacacgcuguggagcaacggcgugcucgaguccgacaugaucauccccaagagccuggccgggcccaucucccagcacaaccaccggccgggcuaccacacccagaccgccgggcccuggcaccugggcaagcucgagcuggacuucaacuacugcgagggcaccacgguggucaucaccgagaacugcgggacccgcggccccagccugcggaccacgaccguguccgggaagcucauccacgaguggugcugccgcagcugcacccugcccccgcugcgguacaugggcgaggacgggugcugguacggcauggagauccgccccaucaacgagaaggaggagaacauggugaagucccucgucagcgccggcuccgggaagguggacaacuucaccaugggcgugcugugccuggccauccucuucgaggaggucaugcgggggaaguucggcaagaagcacaugaucgcgggggugcuguucacguucgugcugcuccugagcggccagaucaccuggcgcgacauggcccacacccugaucaugaucggcuccaacgccagcgaccggauggggaugggcgucaccuaccucgcccugaucgccacguucaagauccagcccuuccuggcgcucggguucuuccugcgcaagcugaccagccgggagaaccuccugcugggcgugggccucgccauggccaccacccugcagcugcccgaggacaucgagcagauggccaacgggaucgcgcucggccugaugacgcugaagcucaucacccaguucgagaccuaccagcuguggaccgcccuggugucccucacgugcagcaacaccaucuucacccugaccgucgccuggcgcacggccacccugauccucgccggggugucccugcugccgcucugccagagcuccagcaugcggaagaccgacuggcugcccaugaccgucgcggccaugggcgugccgccccucccccucuucaucuucucccugaaggacacgcccaagcgccgcagcuggccccugaacgagggggugauggccgucggccucguguccauccuggccagcucccugcuccggaacgacgugcccauggccggcccgcuggucgccggcgggcugcucaucgccugcuacgugaucaccgggaccagcgccgaccugaccguggagaaggccgccgacgucacgugggaggaggaggcggagcagaccggggugucccacaaccugaugaucaccguggacgacgacgggaccaugcgcaucaaggacgacgagaccgagaacauccucacgguccugcugaagaccgcccuccugaucgugagcggcaucuuccccuacuccauccccgccacccugcucguguggcacaccuggcagaagcagacgcagcggagcggcguccugugggacgugcccuccccgcccgagacccagaaggccgagcuggaggaggggguguaccgcaucaagcagcagggcaucuucgggaagacccaggucggcgugggggugcagaaggagggcgucuuccacaccauguggcacgugacgcggggcgccgugcucacccacaacgggaagcgccuggagcccaacugggcgagcgucaagaaggaccugaucuccuacggcgggggcuggcggcucaacgcccaguggcagaagggggaggagguccaggugaucgccgucgagcccggcaagaacccgaagaacuuccagaccaugcccggcaucuuccagaccacgaccggggagaucggcgccaucgcgcuggacuucaagcccgggaccagcggcagcccgaucaucaaccgcgagggcaaggugguggggcuguacggcaacggggucgugaccaagaacggcggguacguguccggcaucgcccagacgaacgccgagcccgacggccccacccccgagcuggaggaggagauguucaagaagcggaaccucaccaucauggaccugcacccggggagcggcaagacccgcaaguaccugcccgccaucguccgggaggccaucaagcgccggcuccgcacgcugauccuggcgcccacccgggugguggccgccgagauggaggaggcccucaaggggcugcccauccgcuaccagaccaccgccacgaaguccgagcacaccggccgggagaucgucgaccugaugugccacgcgaccuucaccaugcgccuccugagcccggugcgggugcccaacuacaaccuggucaucauggacgaggcccacuucacggaccccgccuccaucgccgcccgcggguacaucagcacccgggugggcaugggcgaggcggccgccaucuucaugaccgccacgccgcccgggacggcggaggccuucccccaguccaacgcccccauccaggacgaggagcgcgacauccccgagcgcagcuggaacuccggcaacgaguggaucaccgacuucguggggaagaccgucugguucgugcccagcaucaaggccggcaacgacaucgccaacugccuccggaagaacgggaagaaggugauccagcugucccgcaagaccuucgacacggaguaccagaagacccggcugaacgacugggacuucgucgugaccaccgacaucagcgagaugggcgcgaacuucaaggccgaccgcgugaucgacccccggcgcugccucaagcccgucauccugacggacggccccgagcgggugauccuggccgggccgaugcccgugaccgccgccuccgcggcccagcgccggggccgcgucgggcggaacccccagaaggagaacgaccaguacaucuucaccggccagccccucaacaacgacgaggaccacgcccacuggaccgaggccaagaugcugcuggacaacaucaacaccccggaggggaucauccccgcccucuucgagcccgagcgcgagaaguccgcggccaucgacggcgaguaccggcugaagggcgagucccgcaagacguucguggagcugaugcggcgcggggaccuccccgucuggcuggcccacaagguggccagcgagggcaucaaguacaccgaccggaaguggugcuucgacggggagcgcaacaaccagauccuggaggagaacauggacguggagaucuggaccaaggagggcgagcggaagaagcuccgcccgcgcuggcuggacgcgcggaccuacuccgacccccuggcccucaaggaguucaaggacuucgccgccggccgcaagagcaucgcccuggaccuggucacggagaucgggcgggugcccucccaccucgcgcaccgcacccggaacgcccuggacaaccuggugaugcuccacaccagcgagcacggcgggcgcgccuaccggcacgccgucgaggagcugccggagaccauggagacgcugcuccugcugggccucaugauccugcugaccgggggcgccaugcuguuccugaucagcggcaaggggaucggcaagaccuccaucgggcugaucugcgugaucgugagcuccggcaugcucuggauggcggacgucccccugcaguggaucgccagcgccaucgugcuggaguucuucaugauggugcuccugauccccgagcccgagaagcagcgcaccccgcaggacaaccagcuggccuacgucgugaucgggauccucacgcuggccgcgaucguggccgccaacgagaugggccugcucgagaccaccaagcgggaccugggcauguccaaggagcccggggucgugagccccaccuccuaccuggacguggaccuccaccccgccagcgccuggacgcuguacgcggucgccaccaccgugaucaccccgaugcugcgccacacgaucgagaacuccaccgccaacgugagccucgccgcgaucgccaaccaggccgucgugcugaugggccuggacaagggguggcccaucuccaagauggaccucggcgugccccugcuggcccucgggugcuacagccaggucaacccccugacccugaccgccgcggugcuccugcuggugacgcacuacgccaucaucggcccgggccuccaggccaaggccacccgggaggcccagaagcgcaccgcggccgggaucaugaagaaccccaccgucgacggcaucaugacgaucgaccuggaccccgugaucuacgacuccaaguucgagaagcagcugggccaggugaugcuccugguccugugcgccgugcagcuccugcugaugcggaccagcugggcccucugcgaggcccugacccuggcgaccggccccaucacgacccucugggagggcuccccggggaaguucuggaacaccaccaucgccgugagcauggccaacaucuuccgcggcuccuaccuggccggggcgggccuggccuucagcaucaugaaguccgucgggacgggccggcgcggcaccgggagccagggcgagacccucggggagaaguggaagaagaagcugaaccagcugagccggaaggaguucgaccucuacaagaaguccggcaucaccgagguggaccgcaccgaggccaaggaggggcugaagcggggcgagacgacccaccacgccgugagccgcggcuccgccaagcugcagugguucgucgagcggaacauggugauccccgaggggcgcgugaucgaccucggcugcgggcgcggcggguggagcuacuacugcgcgggccugaagaaggucaccgaggugcggggcuacaccaagggcgggcccgggcacgaggagcccgugccgauguccacguacggcuggaacaucgucaagcugaugagcgggaaggacguguucuaccugccgcccgagaagugcgacacccugcugugcgacaucggcgaguccagccccuccccgaccguggaggagagccgcaccauccggguccugaagaugguggagcccuggcuccgcaacaaccaguucugcaucaaggugcugaaccccuacaugcccacggucaucgagcaccuggagcggcuccagcgcaaguacggcgggaugcuggugcggaacccgcugucccgcaacagcacccacgagauguacuggaucuccaacggcaccgggaacaucgugagcuccgucaacauggugagccggcuccugcugaaccgcuucaccaugacgcaccggcgccccaccaucgagaaggacgucgaccucggcgccggcacccggcacgugaacgccgagcccgagaccccgaacauggacgugaucggggagcgcaucaagcggaucaaggaggagcacuccagcacguggcacuacgacgacgagaaccccuacaagaccugggccuaccacggcuccuacgaggucaaggccaccgggagcgcgagcuccaugaucaacggcguggugaagcugcugaccaagcccugggacgucgugcccauggugacgcagauggccaugaccgacaccaccccguucgggcagcagcgcgucuucaaggagaagguggacacgcggacgccccggcccaugcccggcacccggaaggugauggagaucaccgccgaguggcucuggcgcacgcugggccgcaacaagaagccgcggcugugcacccgcgaggaguucaccaagaagguccggaccaacgccgccaugggggcgguguucacggaggagaaccagugggacagcgcccgcgccgccguggaggacgaggaguucuggaagcucgucgaccgggagcgcgagcugcacaagcugggcaagugcggguccugcguguacaacaugaugggcaagcgggagaagaagcucggggaguucggcaaggcgaagggcagccgcgccaucugguacauguggcugggggcccgguaccuggaguucgaggcccucggcuuccugaacgaggaccacugguucucccgcgagaacagcuacuccgggguggagggcgaggggcugcacaagcucggcuacauccugcgggacaucagcaagauccccggcggggccauguacgcggacgacaccgccggcugggacacccgcaucaccgaggacgaccugcacaacgaggagaagaucacgcagcagauggaccccgagcaccggcagcucgccaacgccaucuucaagcugaccuaccagaacaaggucgugaaggugcagcgccccaccccgaaggggaccgucauggacaucaucucccggaaggaccagcgcggcagcggccagguggggaccuacggccugaacacguucaccaacauggaggcccagcucgugcggcagauggagggggagggcguccuguccaaggcggaccuggagaacccccaccuccuggagaagaagaucacccaguggcuggagaccaaggggguggagcgccucaagcggauggccaucagcggcgacgacugcguggucaagcccaucgacgaccgcuucgccaacgcccugcuggcccucaacgacaugggcaaggugcggaaggacaucccccaguggcagccguccaagggguggcacgacuggcagcagguccccuucugcagccaccacuuccacgagcugaucaugaaggacggccgcaagcuggucgugcccugccgcccccaggacgagcucaucgggcgggcgcgcaucucccagggcgccggguggagccugaaggagacggccugccugggcaaggccuacgcccagauguggucccucauguacuuccaccggcgcgaccugcggcuggcgagcaacgccaucugcuccgccgugccgguccacuggauccccaccagccgcaccaccuggagcauccacgcccaccaccaguggaugacgaccgaggacaugcucaccguguggaaccggguguggaucgaggacaaccccuggauggaggacaagacccccgucacgaccugggaggacgugccguaccugggcaagcgcgaggaccaguggugcgggucccugaucggccucaccagccgggcgaccugggcccagaacauccugacggccauccagcagguccgcucccugaucggggacgaggaguuccucgacuacaugcccagcaugaagcgguuccgcaaggaggaggaguccgagggcgccaucugguga

SEQ ID NO: 9934 - RNA, 9873 nt, Artificial Sequence
  derived and/or modified CDS sequence (opt1) from DENV-3__GU131912__SS-prME
accagccugugccucaugaugaugcugcccgccacccuggccuuccaccucaccagccgggacggggagccgcggaugaucguggggaagaacgagcgcggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaagguggagaccugggcccuccgccacccgggguucaccauccuggcgcuguuccucgcccacuacaucggcaccucccugacccagaagguggugaucuucauccugcucaugcuggugacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccaacaucuucgccggccaccugaagugccggcucaagauggacaagcuggagcugaagggcaugagcuacgccaugugccucaacaccuucgugcugaagaaggaggucuccgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccaucaacaucgaggccgagccgcccuucggggagagcaacaucgugaucggcaucggggacaaggcccucaagaucaacugguacaagaagggcuccagcaucgggaagauguucgaggcgaccgcccggggcgcccgccggauggccauccugggcgacaccgccugggacuucggguccgugggcgggguccugaacagccucggcaagauggugcaccagaucuucggguccgcguacaccgcccuguucagcggcguguccuggaucaugaagaucggcaucgggguccugcucacguggaucggccugaacagcaagaacaccuccaugagcuucuccugcaucgugaucgggaucaucacccuguaccucggcgccgugguccaggccgacauggggugcgugaucaacuggaagggcaaggagcugaagugcggcaacgggaucuucgugaccaacgagguccacacguggaccgagcaguacaaguuccaggccgacagccccaagcgccuggcgaccgccaucgccggcuccugggagaacggggugugcggcauccgcagcaccacgcggauggagaaccuccuguggaagcagaucgccaacgagcugaacuacauccucugggagaacaacaucaagcugaccguggucgugggggacaucaucggcgugcuggagcagggcaagcgcacccucacgccccagccgauggagcugaaguacuccuggaagacgugggggaaggccaagaucgucaccgcggagacccagaacagcuccuucaucaucgacggccccaacacccccgagugccccagcgccucccgggccuggaacgugugggagguggaggacuacggguucggcgucuucacgaccaacaucuggcugaagcuccgcgagguguacacccagagcugcgaccaccggcugaugagcgccgcgaucaaggacgagcgcgccgugcacgccgacaugggcuacuggaucgagucccagaagaacgggagcuggaagcuggagaaggccuccuucaucgaggucaagaccugcaccuggcccaagagccacacgcucugguccaacggcgugcuggagagcgacaugaucauccccaagucccuggccgggcccaucagccagcacaaccaccggccgggcuaccacacccagaccgcggggcccuggcaccucggcaagcuggagcuggacuucaacuacugcgagggcaccacgguggucaucgccgagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgccggggugcuguucaccuucgugcuccugcuguccggccagaucacguggcgcgacauggcgcacacccucaucaugaucggcagcaacgccuccgaccggauggggaugggcgucaccuaccuggcccugaucgccaccuucaagauccagcccuuccucgcccugggguucuuccugcgcaagcucacgagccgggagaaccugcugcucggcgugggccuggcgauggccaccacccugcagcuccccgaggacaucgagcagauggccaacgggaucgcccugggccugaugacccucaagcugaucacgcaguucgagaccuaccagcuguggaccgcgcucgugagccugaccugcuccaacacgaucuucacccugaccgucgccuggcgcaccgccacgcucauccuggccggggugagccugcucccgcugugccaguccagcuccaugcggaagaccgacuggcugcccaugaccgucgccgcgaugggcgugccgccccugccgcuguucaucuucagccugaaggacacccccaagcgcaaguccuggccccucaacgagggggugauggccgucggccuggugagcauccuggccuccagccuccugcgcaacgacgugcccauggccggcccgcuggucgccgggggccuccugaucgcgugcuacgugaucacggggaccuccgccgaccugaccguggagaaggccgccgacgucaccugggaggaggaggccgagcagacgggcgugagccacaaccucaugaucaccguggacgacgacgggaccaugcggaucaaggacgacgagaccgagaacauccugaccguccugcucaagacggcgcugcugaucguguccggcaucuuccccuacagcauccccgccacccuccugguguggcacaccuggcagaagcagacccagcgcuccggcguccugugggacgugcccagcccgcccgagacgcagaaggccgagcucgaggaggggguguaccggaucaagcagcagggcaucuucgggaagacccaggucggcgugggggugcagaaggagggcgucuuccacaccauguggcacgugacccgcggcgccgugcugacgcacaacgggaagcggcuggagcccaacugggccuccgucaagaaggaccucaucagcuacggcgggggcuggcgccuguccgcgcaguggcagaagggggaggagguccaggugaucgccgucgagcccggcaagaacccgaagaacuuccagaccaugcccggcaucuuccagaccaccacgggggagaucggcgccaucgcccuggacuucaagcccgggaccagcggcagcccgaucaucaaccgggagggcaaggugguggggcuguacggcaacggggucgugaccaagaacggcggguacguguccggcaucgcgcagaccaacgccgagcccgacggccccacgcccgagcucgaggaggagauguucaagaagcgcaaccugaccaucauggaccugcacccggggagcggcaagacccggaaguaccuccccgccaucguccgcgaggccaucaagcggcgccugcggacccugauccucgcccccacgcgcgugguggcggccgagauggaggaggcccugaaggggcugcccauccgguaccagaccaccgccuccaagagcgagcacaccggccgcgagaucgucgaccucaugugccacgccacguucaccaugcggcugcuguccccggugcgcgugcccaacuacaaccucaucaucauggacgaggcgcacuucaccgaccccgccagcaucgccgcccggggguacaucuccacccgcgucggcaugggcgaggccgcggccaucuucaugacggccacgccgcccgggaccgccgaggcguucccccagagcaacgcccccauccaggacgaggagcgggacauccccgagcgcuccuggaacagcggcaacgaguggaucaccgacuucguggggaagacggugugguucguccccuccaucaaggccggcaacgacaucgccaacugccugcgcaagaacgggaagaaggugauccagcugagccggaagaccuucgacaccgaguaccagaagacccgccucaacgacugggacuucguggucacgaccgacaucuccgagaugggcgccaacuucaaggcggaccgggugaucgacccccgccggugccugaagcccgugauccugaccgacggccccgagcgcgucauccucgccgggccgaugcccgugaccgccgccagcgccgcgcagcggcgcggccggguggggcgcaacccccagaaggagaacgaccaguacaucuucacgggccagccccugaacaacgacgaggaccacgcccacuggaccgaggccaagaugcugcucgacaacaucaacaccccggaggggaucauccccgcccuguucgagcccgagcgggagaaguccgccgcgaucgacggcgaguaccgccugaagggcgagagccggaagaccuucgucgagcucaugcgccgcggggaccugcccguguggcuggcccacaaggucgccuccgagggcaucaaguacaccgaccgcaaguggugcuucgacggggagcggaacaaccagauccucgaggagaacauggacguggagaucuggacgaaggagggcgagcgcaagaagcugcggccgcgcuggcuggacgcccgcaccuacagcgacccccucgcgcugaaggaguucaaggacuucgccgccggccggaaguccaucgcccuggaccucgugaccgagaucgggcgcguccccagccaccuggcccaccggacccgcaacgcgcuggacaaccucgugaugcugcacacgagcgagcacggcgggcgggccuaccgccacgccguggaggagcugccggagaccauggagacccuccugcugcucggccugaugauccugcucaccgggggcgccaugcuguuccugaucuccggcaaggggaucggcaagacgagcaucgggcucaucugcgucaucguguccagcggcaugcuguggauggccgacgugccccugcaguggaucgcguccgccaucguccucgaguucuucaugauggugcugcugauccccgagcccgagaagcagcggaccccgcaggacaaccagcucgccuacguggucaucgggauccugacccuggccgccaucguggcggccaacgagaugggccuccuggagaccacgaagcgcgaccugggcaugagcaaggagcccgggguggucucccccaccagcuaccucgacguggaccugcaccccgccuccgccuggacccuguacgccguggcgaccacggucaucaccccgaugcuccggcacaccaucgagaacagcaccgccaacgugucccuggccgccaucgcgaaccaggccgugguccugaugggccucgacaagggguggcccaucagcaagauggaccugggcgugccccugcucgcccuggggugcuacucccaggugaacccccugacgcucaccgccgccguccugcugcucgugacccacuacgcgaucaucggcccgggccugcaggccaaggccacccgcgaggcccagaagcggacggccgcggggaucaugaagaaccccaccguggacggcaucaugaccaucgaccuggaccccgucaucuacgacagcaaguucgagaagcagcucggccaggugaugcugcuggugcucugcgccguccagcugcugcucaugcgcaccuccugggcccugugcgaggcccugacgcucgccaccggccccaucaccacccugugggagggcagcccggggaaguucuggaacacgaccaucgcgguguccauggccaacaucuuccggggcagcuaccuggccggggccggccucgcguucuccaucaugaaguccguggggaccggccgccggggcaccgggagccagggcgagacgcugggggagaaguggaagaagaagcugaaccagcucucccgcaaggaguucgaccuguacaagaaguccggcaucaccgaggucgaccggaccgaggccaaggaggggcugaagcgcggcgagaccacccaccacgccgugucccggggcagcgccaagcuccagugguucguggagcgcaacauggucauccccgaggggcgggugaucgaccugggcugcgggcgcggcgggugguccuacuacugcgccggccugaagaaggugacggagguccgcggcuacaccaagggcgggcccgggcacgaggagcccgugccgaugagcaccuacggcuggaacaucgugaagcucauguccgggaaggacgucuucuaccugccgcccgagaagugcgacacccugcugugcgacaucggcgagagcucccccagcccgacgguggaggagucccggaccauccgcgugcuccggauggucgagcccuggcugcgcaacaaccaguucugcaucaaggugcugaaccccuacaugcccaacgugaucgagcaccucgagcggcugcagcgcaaguacggcgggaugcugguccggaacccgcucagccgcaacuccacccacgagauguacuggaucagcaacggcaccgggaacaucguguccagcgugaacauggucucccggcugcugcucaaccgcuucacgaugacccaccggcgccccaccaucgagaaggacguggaccugggcgcgggcacccggcacgucaacgccgagcccgagacgccgaacauggacgugaucggggagcgcaucaagcggaucaaggaggagcacagcuccaccuggcacuacgacgacgagaaccccuacaagaccugggccuaccacggcagcuacgaggugaaggccaccgggagcgccuccagcaugaucaacggcgucgugaagcugcucacgaagcccugggacgugguccccauggugacccagauggcgaugaccgacaccacgccguucgggcagcagcgcguguucaaggagaaggucgacacccggacgccccggcccaugcccggcacccggaaggugauggagaucacggccgaguggcuguggcgcacccugggccgcaacaagaagccgcggcucugcacccgcgaggaguucaccaagaaggugcggacgaacgccgccaugggggccgucuucaccgaggagaaccagugggacuccgcgcgcgccgccguggaggacgaggaguucuggaagcugguggacaaggagcgggagcugcacaagcucggcaagugcgggagcugcgucuacaacaugaugggcaagcgcgagaagaagcugggggaguucggcaaggccaagggcucccgggcgaucugguacauguggcugggggcccgcuaccucgaguucgaggcccugggcuuccugaacgaggaccacugguucagccgggagaacuccuacagcgggguggagggcgaggggcuccacaagcugggcuacauccugcgcgacaucuccaagauccccggcggggccauguacgccgacgacaccgcgggcugggacacccggaucacggaggacgaccuccacaacgaggagaagaucacccagcagauggaccccgagcaccgccagcuggccaacgccaucuucaagcugaccuaccagaacaagguggucaaggugcagcggcccaccccgaaggggacggugauggacaucaucagccgcaaggaccagcggggcuccggccaggucgggaccuacggccucaacaccuucaccaacauggaggcccagcuggugcgccagauggagggggagggcgugcugagcgaggccgaccucgagaacccccaccuccuggagaagaagaucacccaguggcucgagacgaagggggucgagcggcugaagcgcauggcgaucuccggcgacgacugcguggugaagcccaucgacgaccgguucgccaacgcccugcucgcccugaacgacaugggcaagguccgcaaggacaucccccaguggcagccgagcaagggguggcacgacuggcagcagguccccuucugcucccaccacuuccacgagcugaucaugaaggacggccggaagcucgugguccccugccgcccccaggacgagcugaucgggcgcgcccggaucagccagggcgcgggguggucccugaaggagaccgccugccucggcaaggccuacgcccagauguggagccugauguacuuccaccgccgggaccugcgccucgccuccaacgcgaucugcagcgccgugccggugcacuggauccccaccagccggaccacgugguccauccacgcccaccaccaguggaugaccaccgaggacaugcugaccgucuggaaccgcguguggaucgaggacaaccccuggauggaggacaagacgcccgugaccaccugggaggacgucccguaccugggcaagcgggaggaccaguggugcgggagccucaucggccugaccucccgcgccacgugggcgcagaacauccugaccgccauccagcagguccggagccucaucggggacgaggaguuccuggacuacaugcccuccaugaagcgcuuccggaaggaggaggagagcgagggcgccaucugguga

SEQ ID NO: 9935 - RNA, 9873 nt, Artificial Sequence
  derived and/or modified CDS sequence (opt1) from DENV-3__GU131913__SS-prME
accagccugugccucaugaugaugcugcccgcgacccuggccuuccaccucaccagccgggacggcgagccgcggaugaucguggggaagaacgagcggggcaagagccugcuguucaagaccgcguccgggaucaacaugugcacccucaucgccauggaccugggcgagaugugcgacgacaccgucaccuacaagugcccccugaucgccgagguggagcccgaggacaucgacugcuggugcaaccucaccagcaccugggugaccuacgggaccugcaaccaggccggcgagcaccggcgggacaagcgguccgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccaucaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgugggcgggguccugaacucccucggcaagauggugcaccagaucuucgggagcgcguacaccgcccuguucuccggcgugagcuggaucaugaagaucggcaucgggguccugcucacguggaucggccugaacuccaagaacaccagcauguccuucagcugcaucgugaucgggaucgugacccuguaccucggcgccgucgugcaggccgacauggggugcgugaucaacuggaagggcaaggagcugaagugcggcaacgggaucuucgucaccaacgaggugcacacguggaccgagcaguacaaguuccaggccgacucccccaagcgccuggcgaccgccaucgccggcgccugggagaacggggugugcggcauccgcagcaccacgcggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacuccuggaagacgugggggaaggcgaagaucgugaccgccgagacccagaacagcuccuucaucaucgacggccccaacacccccgagugccccagcgccucccgggccuggaacgugugggaggucgaggacuacggguucggcguguucacgaccaacaucuggcugaagcuccgcgaggugcacacccagagcugcgaccaccggcugaugagcgcggccaucaaggacgagcgcgccguccacgccgacaugggcuacuggaucgagucccagaagaacgggagcuggaagcuggagaaggccuccuucaucgaggugaagaccugcaccuggcccaagagccacacgcucugguccaacggcgugcuggagagcgacaugaucauccccaagucccuggcggggcccaucagccagcacaaccaccggccgggcuaccacacccagaccgccgggcccuggcaccucggcaagcuggagcuggacuucaacuacugcgagggcaccacggucgugaucgccgagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgcgggggugcuguucaccuucguccuccugcuguccggccagaucacguggcgcgacauggcccacacccucaucaugaucggcagcaacgccuccgaccggauggggaugggcgugaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgucagccugaccugcuccaacacgaucuucacccugaccguggccuggcgcaccgccacgcucauccuggccggggucagccugcucccgcugugccaguccagcuccaugcggaagaccgacuggcugcccaugaccguggcggccaugggcgugccgccccugccgcuguucaucuucagccugaaggacacccccaagcgcaaguccuggccccucaacgagggggucauggccgugggccuggugagcauccuggccuccagccuccugcgcaacgacguccccauggccggcccgcugguggccggcgggcuccugaucgccugcuacgugaucacggggaccuccgccgaccugaccgucgagaaggccgccgacgugaccugggaggaggaggcggagcagacgggggugagccacaaccucaugaucaccgucgacgacgacgggaccaugcggaucaaggacgacgagaccgagaacauccugaccgugcugcucaagacggcccugcugaucguguccggcaucuuccccuacagcauccccgccacccuccuggucuggcacaccuggcagaagcagacccagcgcuccggcgugcugugggacgugcccagcccgcccgagacgcagaaggccgagcucgaggagggggucuaccggaucaagcagcagggcaucuucgggaagacccaggugggcguggggguccagaaggagggcguguuccacaccauguggcacgugacccgcggcgccguccugacgcacaacgggaagcggcuggagcccaacugggcguccgugaagaaggaccucaucagcuacggcgggggcuggcgccuguccgcccaguggcagaagggggaggaggugcaggucaucgccguggagcccggcaagaacccgaagaacuuccagaccaugcccggcaucuuccagaccaccacgggggagaucggcgccaucgcgcuggacuucaagcccgggaccagcggcagcccgaucaucaaccgggagggcaagguggucgggcuguacggcaacgggguggugaccaagaacggcggguacgucuccggcaucgcccagaccaacgccgagcccgacggccccacgcccgagcucgaggaggagauguucaagaagcgcaaccugaccaucauggaccugcacccggggagcggcaagacccggaaguaccuccccgccaucgugcgcgaggccaucaagcggcgccugcggacccugauccucgcgcccacgcgcguggucgccgccgagauggaggaggcccugaaggggcugcccauccgguaccagaccaccgccaccaaguccgagcacacgggccgcgagaucguggaccucaugugccacgcgaccuucaccaugcggcugcugagcccggugcgcguccccaacuacaaccucgugaucauggacgaggcccacuucaccgaccccgccuccaucgccgcccggggguacaucagcacgcgcgugggcaugggcgaggcggccgccaucuucaugaccgccacgccgcccgggaccgcggaggccuucccccaguccaacgcccccauccaggacgaggagcgggacauccccgagcgcagcuggaacuccggcaacgaguggaucacggacuucgucgggaagaccgugugguucgugcccagcaucaaggccggcaacgacaucgccaacugccugcgcaagaacgggaagaaggucauccagcugucccggaagaccuucgacaccgaguaccagaagacgcgccucaacgacugggacuucguggugaccaccgacaucagcgagaugggcgcgaacuucaaggccgaccgggucaucgacccccgccggugccugaagcccgugauccugaccgacggccccgagcgcgugauccucgccgggccgaugcccgucacggccgccuccgcggcccagcggcgcggccggguggggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgcggccaucgacggcgaguaccgccugaagggcgagucccggaagaccuucgucgagcucaugcgccgcggggaccugcccguguggcuggcccacaagguggccagcgagggcaucaaguacacggaccgcaaguggugcuucgacggggagcggaacaaccagauccucgaggagaacauggacgucgagaucuggaccaaggagggcgagcgcaagaagcugcggccgcgcuggcuggacgcgcgcaccuacuccgacccccucgcccugaaggaguucaaggacuucgccgccggccgcaagagcaucgcccuggaccucgugaccgagaucgggcgcgugcccucccaccuggcgcaccggacgcgcaacgcccuggacaaccucgucaugcugcacaccagcgagcacggcgggcgggccuaccgccacgccguggaggagcugccggagaccauggagacccuccugcugcucggccugaugauccugcucaccgggggcgccaugcuguuccugaucagcggcaaggggaucggcaagaccuccaucgggcucaucugcgugaucgucagcuccggcaugcuguggauggcggacgugccccugcaguggaucgccagcgccaucgugcucgaguucuucaugaugguccugcugauccccgagcccgagaagcagcggaccccgcaggacaaccagcucgccuacguggugaucgggauccugacccuggccgcgaucgucgccgccaacgagaugggccuccuggagacgaccaagcgcgaccugggcauguccaaggagcccgggguggugagccccaccuccuaccucgacgucgaccugcaccccgccagcgccuggacccuguacgcgguggccacgaccgugaucaccccgaugcuccggcacaccaucgagaacuccacggccaacgucagccuggccgcgaucgccaaccaggccguggugcugaugggccucgacaagggguggcccaucuccaagauggaccugggcgucccccugcucgcccuggggugcuacagccaggugaacccccugacccucaccgccgcggugcugcugcucgucacccacuacgccaucaucggcccgggccugcaggccaaggccacgcgcgaggcccagaagcggaccgcggccgggaucaugaagaaccccaccguggacggcaucaugaccaucgaccuggaccccgugaucuacgacuccaaguucgagaagcagcucgggcaggucaugcugcuggugcucugcgccgugcagcugcugcucaugcgcacgagcugggcccugugcgaggcccugacccucgcgaccggccccaucaccacgcugugggagggcuccccggggaaguucuggaacaccaccaucgccgucagcauggccaacaucuuccggggcuccuaccuggccggggcgggccucgccuucagcaucaugaaguccguggggaccggccgccggggcacggggagccagggcgagacccugggggagaaguggaagaagaagcugaaccagcucagccgcaaggaguucgaccuguacaagaaguccggcaucaccgagguggaccggaccgaggccaaggaggggcugaagcgcggcgagaccacgcaccacgccgucagccggggcuccgccaagcuccagugguucguggagcgcaacauggugauccccgaggggcgggucaucgaccugggcugcgggcgcggcggguggagcuacuacugcgcgggccugaagaaggugaccgaggugcgcggcuacaccaagggcggccccgggcacgaggagcccgucccgauguccaccuacggcuggaacaucgugaagcucaugagcgggaaggacguguucuaccugccgcccgagaagugcgacacgcugcugugcgacaucggcgaguccagccccuccccgaccgucgaggagagccggaccauccgcgugcucaagaugguggagcccuggcugcggaacaaccaguucugcaucaagguccugaaccccuacaugcccaacgugaucgagcaccucgagcgccugcagcggaaguacggcgggaugcuggugcgcaacccgcucucccggaacagcacccacgagauguacuggaucuccaacggcacggggaacaucgucagcuccgugaacauggucagccgccugcugcucaaccgguucaccaugacccaccgccggcccaccaucgagaaggacguggaccugggcgccggcacgcgccacgugaacgccgagcccgagaccccgaacauggacgucaucggggagcggaucaagcgcaucaaggaggagcacuccagcaccuggcacuacgacgacgagaaccccuacaagaccugggccuaccacggcuccuacgaggugaaggccacggggagcgcgagcuccaugaucaacggcguggucaagcugcucaccaagcccugggacguggugcccauggucacccagauggccaugaccgacacgaccccguucgggcagcagcggguguucaaggagaagguggacacccgcacgccccggcccaugcccggcacgcgcaaggucauggagaucaccgccgaguggcuguggcggacccugggccgcaacaagaagccgcgccucugcacccgggaggaguucacgaagaaggugcgcaccaacgccgccaugggggcgguguucaccgaggagaaccagugggacagcgcccgggccgccgucgaggacgaggaguucuggaagcugguggacaaggagcgcgagcugcacaagcucggcaagugcggguccugcguguacaacaugaugggcaagcgggagaagaagcugggggaguucggcaaggcgaagggcagccgcgccaucugguacauguggcugggggcccgguuccucgaguucgaggcccugggcuuccugaacgaggaccacugguucucccgcgagaacagcuacuccggggucgagggcgaggggcuccacaagcugggcuacauccugcgggacaucagcaagauccccggcggggccauguacgcggacgacaccgccggcugggacacgcgcaucaccgaggacgaccuccacaacgaggagaagaucacccagcagauggaccccgagcaccggcagcuggccaacgccaucuucaagcugaccuaccagaacaagguggugaagguccagcgccccacgccgaaggggaccgugauggacaucaucucccggaaggaccagcgcggcagcggccagguggggaccuacggccucaacaccuucaccaacauggaggcccagcugguccggcagauggagggggagggcgugcuguccgaggcggaccucgagaacccccaccuccuggagaagaagaucacgcaguggcucgagaccaaggggguggagcgccugaagcggauggccaucagcggcgacgacugcgucgugaagcccaucgacgaccgcuucgccaacgcccugcucgcccugaacgacaugggcaaggugcggaaggacaucccccaguggcagccguccaagggguggcacgacuggcagcagguccccuucugcagccaccacuuccacgagcugaucaugaaggacggccgcaagcucguggugcccugccggccccaggacgagcugaucgggcgcgcgcgcaucucccagggcgccggguggagccugaaggagaccgccugccucggcaaggccuacgcccagauguggucccugauguacuuccaccggcgcgaccugcggcucgcgagcaacgccaucugcuccgccgucccggugcacuggauccccaccagccgcacgaccuggagcauccacgcccaccaccaguggaugaccaccgaggacaugcugacgguguggaaccgggucuggaucgaggacaaccccuggaugggcgacaagacccccgugaccaccugggaggacgugccguaccuggggaagcgcgaggaccaguggugcggcucccucaucgggcugacgagccgggcgaccugggcccagaacauccugaccgccauccagcagguccgcucccucaucggcgacgaggaguuccuggacuacaugcccagcaugaagcgguuccgcaaggaggaggaguccgagggggccaucugguga

SEQ ID NO: 9936 - RNA, 9873 nt, Artificial Sequence
  derived and/or modified CDS sequence (opt1) from DENV-3__GU131914__SS-prME
accagccugugccucaugaugaugcugcccgcgacccuggccuuccaccucaccagccgggacggcgagccgcggaugaucguggggaagaacgagcggggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgggacaagcgguccguggcccuggcgccccacgugggcauggggcuggacacccgcacccagaccuggaugagcgccgagggcgccuggcgccagguggagaagguggagacgugggcccuccgccacccgggguucaccauccuggcgcuguuccucgcccacuacaucggcaccucccugacccagaagguggugaucuucauccugcucaugcuggugacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccaucaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgugggcgggguccugaacucccucggcaagauggugcaccagaucuucgggagcgcguacaccgcccuguucuccggcgugagcuggaucaugaagaucggcaucgggguccugcucacguggaucggccugaacuccaagaacaccagcauguccuucagcugcaucgugaucgggaucaucacccuguaccucggcgccgugguccaggccgacauggggugcgugaucaacuggaagggcaaggagcugaagugcggcaacgggaucuucgugaccaacgagguccacacguggaccgagcaguacaaguuccaggccgacucccccaagcgccuggcgaccgccaucgccggcgccugggagaacggggugugcggcauccgcagcaccacgcggauggagaaccuccuguggaagcagaucgccaacgagcugaacuacauccucugggagaacaacaucaagcugaccguggucgugggggacaucaucggcgugcuggagcagggcaagcgcacccucacgccccagccgauggagcugaaguacuccuggaagacgugggggaaggcgaagaucgucaccgccgagacccagaacagcuccuucaucaucgacggccccaacacccccgagugccccagcgccucccgggccuggaacgugugggagguggaggacuacggguucggcgucuucacgaccaacaucuggcugaagcuccgcgaggugcacacccagagcugcgaccaccggcugaugagcgcggccaucaaggacgagcgcgccgugcacgccgacaugggcuacuggaucgagucccagaagaacgggagcuggaagcuggagaaggccuccuucaucgaggucaagaccugcaccuggcccaagagccacacgcucugguccaacggcgugcuggagagcgacaugaucauccccaagucccuggcggggcccaucagccagcacaaccaccggccgggcuaccacacccagaccgccgggcccuggcaccucggcaagcuggagcuggacuucaacuacugcgagggcaccacgguggucaucgccgagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgcgggggugcuguucaccuucgugcuccugcuguccggccagaucacguggcgcgacauggcccacacccucaucaugaucggcagcaacgccuccgaccggauggggaugggcgucaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccgucgccuggcgcaccgccacgcucauccuggccggggugagccugcucccgcugugccaguccagcuccaugcggaagaccgacuggcugcccaugaccgucgcggccaugggcgugccgccccugccgcuguucaucuucagccugaaggacacccccaagcgcaaguccuggccccucaacgagggggugauggccgucggccuggugagcauccuggccuccagccuccugcgcaacgacgugcccauggccggcccgcuggucgccggcgggcuccugaucgccugcuacgugaucacggggaccuccgccgaccugaccguggagaaggccgccgacgucaccugggaggaggaggcggagcagacgggggugagccacaaccucaugaucaccguggacgacgacgggaccaugcggaucaaggacgacgagaccgagaacauccugaccguccugcucaagacggcccugcugaucguguccggcaucuuccccuacagcauccccgccacccuccugguguggcacaccuggcagaagcagacccagcgcuccggcguccugugggacgugcccagcccgcccgagacgcagaaggccgagcucgaggaggggguguaccggaucaagcagcagggcaucuucgggaagacccaggucggcgugggggugcagaaggagggcgucuuccacaccauguggcacgugacccgcggcgccgugcugacgcacaacgggaagcggcuggagcccaacugggcguccgucaagaaggaccucaucagcuacggcgggggcuggcgccuguccgcccaguggcagaagggggaggagguccaggugaucgccgucgagcccggcaagaacccgaagaacuuccagaccaugcccggcaucuuccagaccaccacgggggagaucggcgccaucgcgcuggacuucaagcccgggaccagcggcagcccgaucaucaaccgggagggcaaggugguggggcuguacggcaacggggucgugaccaagaacggcggguacguguccggcaucgcccagaccaacgccgagcccgacggccccacgcccgagcucgaggaggagauguucaagaagcgcaaccugaccaucauggaccugcacccggggagcggcaagacccggaaguaccuccccgccaucguccgcgaggccaucaagcggcgccugcggacccugauccucgcgcccacgcgcgugguggccgccgagauggaggaggcccugaaggggcugcccauccgguaccagaccaccgccaccaaguccgagcacacgggccgcgagaucgucgaccucaugugccacgcgaccuucaccaugcggcugcugagcccggugcgcgugcccaacuacaaccucgucaucauggacgaggcccacuucaccgaccccgccuccaucgccgcccggggguacaucagcacgcgcgugggcaugggcgaggcggccgccaucuucaugaccgccacgccgcccgggaccgcggaggccuucccccaguccaacgcccccauccaggacgaggagcgggacauccccgagcgcagcuggaacuccggcaacgaguggaucacggacuucguggggaagaccgucugguucgugcccagcaucaaggccggcaacgacaucgccaacugccugcgcaagaacgggaagaaggugauccagcugucccggaagaccuucgacaccgaguaccagaagacgcgccucaacgacugggacuucgucgugaccaccgacaucagcgagaugggcgcgaacuucaaggccgaccgggugaucgacccccgccggugccugaagcccgucauccugaccgacggccccgagcgcgugauccucgccgggccgaugcccgugacggccgccuccgcggcccagcggcgcggccgggucgggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgcggccaucgacggcgaguaccgccugaagggcgagucccggaagaccuucguggagcucaugcgccgcggggaccugcccgucuggcuggcccacaagguggccagcgagggcaucaaguacacggaccgcaaguggugcuucgacggggagcggaacaaccagauccucgaggagaacauggacguggagaucuggaccaaggagggcgagcgcaagaagcugcggccgcgcuggcuggacgcgcgcaccuacuccgacccccucgcccugaaggaguucaaggacuucgccgccggccgcaagagcaucgcccuggaccucgucaccgagaucgggcgcgugcccucccaccuggcgcaccggacgcgcaacgcccuggacaaccucgugaugcugcacaccagcgagcacggcgggcgggccuaccgccacgccgucgaggagcugccggagaccauggagacccuccugcugcucggccugaugauccugcucaccggcggggccaugcuguuccugaucagcgggaaggggaucggcaagaccuccaucgggcucaucugcgugaucgugagcuccggcaugcuguggauggcggacgucccccugcaguggaucgccagcgccaucgugcucgaguucuucaugauggugcugcugauccccgagcccgagaagcagcggaccccgcaggacaaccagcucgccuacgucgugaucgggauccugacccuggccgcgaucguggccgccaacgagaugggccuccuggagacgaccaagcgcgaccugggcauguccaaggagcccggggucgugagccccaccuccuaccucgacguggaccugcaccccgccagcgccuggacccuguacgcggucgccacgaccgugaucaccccgaugcuccggcacaccaucgagaacuccacggccaacgugagccuggccgcgaucgccaaccaggccgucgugcugaugggccucgacaagggguggcccaucuccaagauggaccugggcgugccccugcucgcccuggggugcuacagccaggucaacccccugacccucaccgccgcggugcugcugcucgugacccacuacgccaucaucggcccgggccugcaggccaaggccacgcgcgaggcccagaagcggaccgcggccgggaucaugaagaaccccaccgucgacggcaucaugaccaucgaccuggaccccgugaucuacgacuccaaguucgagaagcagcucggccaggugaugcugcugguccucugcgccgugcagcugcugcucaugcgcacgagcugggcccugugcgaggcccugacccucgcgaccggccccaucaccacgcugugggagggcuccccggggaaguucuggaacaccaccaucgccgugagcauggccaacaucuuccggggcuccuaccuggccggggcgggccucgccuucagcaucaugaaguccgucgggaccggccgccggggcacggggagccagggcgagacccugggggagaaguggaagaagaagcugaaccagcucagccgcaaggaguucgaccuguacaagaaguccggcaucaccgagguggaccggaccgaggccaaggaggggcugaagcgcggcgagaccacgcaccacgccgugagccggggcuccgccaagcuccagugguucgucgagcgcaacauggugauccccgaggggcgggugaucgaccugggcugcgggcgcggcggguggagcuacuacugcgcgggccugaagaaggucaccgaggugcgcggcuacaccaagggcggccccgggcacgaggagcccgugccgauguccaccuacggcuggaacaucgucaagcucaugagcgggaaggacguguucuaccugccgcccgagaagugcgacacgcugcugugcgacaucggcgaguccagccccuccccgaccguggaggagagccggaccauccgcguccucaagaugguggagcccuggcugcggaacaaccaguucugcaucaaggugcugaaccccuacaugcccaacgucaucgagcaccucgagcgccugcagcggaaguacggcgggaugcuggugcgcaacccgcucucccggaacagcacccacgagauguacuggaucuccaacggcacggggaacaucgugagcuccgucaacauggugagccgccugcugcucaaccgguucaccaugacccaccgccggcccaccaucgagaaggacgucgaccugggcgccggcacgcgccacgugaacgccgagcccgagaccccgaacauggacgugaucggggagcggaucaagcgcaucaaggaggagcacuccagcaccuggcacuacgacgacgagaaccccuacaagaccugggccuaccacggcuccuacgaggucaaggccacggggagcgcgagcuccaugaucaacggcguggugaagcugcucaccaagcccugggacgucgugcccauggugacccagauggccaugaccgacacgaccccguucgggcagcagcgggucuucaaggagaagguggacacccgcacgccccggcccaugcccggcacgcgcaaggugauggagaucaccgccgaguggcuguggcggacccugggccgcaacaagaagccgcgccucugcacccgggaggaguucacgaagaagguccgcaccaacgccgccaugggggcgguguucaccgaggagaaccagugggacagcgcccgggccgccguggaggacgaggaguucuggaagcuggucgacaaggagcgcgagcugcacaagcucggcaagugcggguccugcguguacaacaugaugggcaagcgggagaagaagcugggggaguucggcaaggcgaagggcagccgcgccaucugguacauguggcugggggcccgguuccucgaguucgaggcccugggcuuccugaacgaggaccacugguucucccgcgagaacagcuacuccgggguggagggcgaggggcuccacaagcugggcuacauccugcgggacaucagcaagauccccggcggggccauguacgcggacgacaccgccggcugggacacgcgcaucaccgaggacgaccuccacaacgaggagaagaucacccagcagauggaccccgagcaccggcagcuggccaacgccaucuucaagcugaccuaccagaacaaggucgugaaggugcagcgccccacgccgaaggggaccgucauggacaucaucucccggaaggaccagcgcggcagcggccagguggggaccuacggccucaacaccuucaccaacauggaggcccagcuggugcggcagauggagggggagggcguccuguccgaggcggaccucgagaacccccaccuccuggagaagaagaucacgcaguggcucgagaccaaggggguggagcgccugaagcggauggccaucagcggcgacgacugcguggucaagcccaucgacgaccgcuucgccaacgcccugcucgcccugaacgacaugggcaaggugcggaaggacaucccccaguggcagccguccaagggguggcacgacuggcagcagguccccuucugcagccaccacuuccacgagcugaucaugaaggacggccgcaagcucgucgugcccugccggccccaggacgagcugaucgggcgcgcgcgcaucucccagggcgccggguggagccugaaggagaccgccugccucggcaaggccuacgcccagauguggucccugauguacuuccaccggcgcgaccugcggcucgcgagcaacgccaucugcuccgccgugccgguccacuggauccccaccagccgcacgaccuggagcauccacgcccaccaccaguggaugaccaccgaggacaugcugacgguguggaaccggguguggaucgaggacaaccccuggaugggcgacaagacccccgucaccaccugggaggacgugccguaccuggggaagcgcgaggaccaguggugcggcucccucaucgggcugacgagccgggcgaccugggcccagaacauccugaccgccauccagcagguccgcucccucaucggcgacgaggaguuccuggacuacaugcccagcaugaagcgguuccgcaaggaggaggaguccgagggggccaucugguga

SEQ ID NO: 9937 - RNA, 9873 nt, Artificial Sequence
  derived and/or modified CDS sequence (opt1) from DENV-3__GU131915__SS-prME
accagccugugccucaugaugaugcugcccgccacccuggccuuccaccucaccagccgcgacggcgagccgcggaugaucguggggaagaacgagcgcggcaagagccugcuguucaagaccgcgagcgggaucaacaugugcacccucaucgccauggaccugggcgagaugugcgacgacaccgugaccuacaagugcccccugaucgccgaggccgagcccgaggacaucgacugcuggugcaaccucaccagcaccugggugaccuacgggaccugcaaccaggccggcgagcaccggcgcgacaagcgguccguggcgcuggcgccccacgugggcauggggcuggacacccgcacccagaccuggaugagcgccgagggcgccuggcgccagguggagaagguggagacgugggcgcuccgccacccgggguucaccauccuggcccuguuccucgcccacuacaucggcaccucccugacccagaagguggugaucuucauccugcucaugcuggugacgcccagcaugaccaugcggugcgucggggugggcaaccgcgacuucguggagggccuguccggggccaccugggucgacguggugcucgagcacggcgggugcgucaccacgauggccaagagcaagcccacccuggacaucgagcugcagaagaccgaggcgacccagcucgccacgcugcggaagcugugcaucgagggcaagaucaccaacaucaccaccgacucccgcugccccacgcagggcgaggccacccucccggaggagcaggaccagaacuacgugugcaagcacaccuacguggaccggggguggggcaacgggugcggccuguucgggaagggcagccuggugaccugcgccaaguuccagugccucgagcccaucgagggcaagguggugcagcacgagaaccugaaguacacggucaucaucaccgugcacaccggggaccagcaccaggugggcaacgacacccagggggucacgguggagaucacgccccaggccuccaccgucgaggcggugcugcccgaguacggcacccucgggcuggagugcagcccgcgcaccggccuggacuucaacgagaugauccuccugacgaugaagaacaaggccuggauggugcaccggcagugguucuucgaccugccccuccccuggaccuccggcgccaccaccgagacgcccaccuggaaccgcaaggagcugcuggucaccuucaagaacgcccacgccaagaagcaggagguggugguccucgggagccaggagggcgcgaugcacaccgcccugacgggggccaccgagauccagaacuccggcgggaccagcaucuucgccggccaccugaagugccggcucaagauggacaagcuggagcugaagggcauguccuacgccaugugccucaacaccuucgugcugaagaaggaggugagcgagacgcagcacgggaccauccugaucaaggucgaguacaagggcgaggacgcgccgugcaagauccccuucagcaccgaggacgggcagggcaaggcccacuccggccgccugaucaccgccaaccccguggugacgaagaaggaggagcccgucaacaucgaggccgagccgcccuucggggagagcaacaucgugaucggcaucggggacaaggcgcucaagaucaacugguacaagaagggcuccagcaucgggaagauguucgaggccaccgcccggggcgcccgccggauggccauccugggcgacaccgcgugggacuucggguccgugggcgggguccugaacagccucggcaagauggugcaccagaucuucggguccgccuacaccgcccuguucagcggcguguccuggaucaugaagaucggcaucgggguccugcucacguggaucggccugaacagcaagaacaccuccaugagcuucuccugcaucgugaucgggaucaucacccuguaccucggcgccgugguccaggccgacauggggugcgugaucaacuggaagggcaaggagcugaagugcggcagcgggaucuucgugaccaacgagguccacacguggaccgagcaguacaaguuccaggcggacucccccaagcgccuggccaccgccaucgccggcgccugggagaacggggugugcggcauccgcagcaccacgcggauggagaaccuccuguggaagcagaucgcgaacgagcugaacuacauccucugggagaacaacaucaagcugaccguggucgugggggacaucaucggcgugcuggagcagggcaagcgcacccucacgccccagccgauggagcugaaguacuccuggaagacgugggggaaggccaagaucgucaccgccgagacccagaacagcuccuucaucaucgacggccccaacacccccgagugccccagcgccagccgggcguggaacgugugggagguggaggacuacggguucggcgucuucacgaccaacaucuggcugaagcuccgcgagguguacacccaguccugcgaccaccggcugaugagcgccgccaucaaggacgagcgcgccgugcacgccgacaugggcuacuggaucgagucccagaagaacgggagcuggaagcuggagaaggcguccuucaucgaggucaagaccugcaccuggcccaagagccacacgcucugguccaacggcgugcuggagagcgacaugaucauccccaagucccuggccgggcccaucagccagcacaaccaccggccgggcuaccacacccagaccgccgggcccuggcaccucggcaagcuggagcuggacuucaacuacugcgagggcaccacgguggucaucaccgagaacugcgggacccgcggccccucccuccggaccacgaccgugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgcgggggugcuguucacguucgugcuccugcuguccggccagaucaccuggcgcgacauggcccacacccucaucaugaucggcagcaacgccagcgaccggauggggaugggcgucaccuaccuggcccugaucgccacguucaagauccagcccuuccucgcgcugggguucuuccugcgcaagcucaccucccgggagaaccugcugcucggcgugggccuggccauggccaccacccugcagcuccccgaggacaucgagcagauggccaacgggaucgcgcugggccugaugacgcucaagcugaucacccaguucgagaccuaccagcuguggaccgcccucgugagccugacgugcuccaacaccaucuucacccugaccgucgccuggcgcacggccacccucauccuggccggggugagccugcucccgcugugccaguccagcuccaugcggaagaccgacuggcugcccaugaccgucgcggccaugggcgugccgccccugccgcuguucaucuucagccugaaggacacgcccaagcgccgcuccuggccccucaacgagggggugauggccgucggccuggugagcauccuggccuccagccuccugcggaacgacgugcccauggccggcccgcuggucgccggcgggcuccugaucgccugcuacgugaucaccgggaccuccgccgaccugaccguggagaaggccgccgacgucacgugggaggaggaggcggagcagaccggggugagccacaaccucaugaucaccguggacgacgacgggaccaugcgcaucaaggacgacgagaccgagaacauccugacgguccugcucaagaccgcccugcugaucguguccggcaucuuccccuacagcauccccgccacccuccugguguggcacaccuggcagaagcagacgcagcgguccggcguccugugggacgugcccagcccgcccgagacccagaaggccgagcucgaggaggggguguaccgcaucaagcagcagggcaucuucgggaagacccaggucggcgugggggugcagaaggagggcgucuuccacaccauguggcacgugacgcggggcgccgugcugacccacaacgggaagcgccuggagcccaacugggcguccgucaagaaggaccucaucagcuacggcgggggcuggcggcugaacgcccaguggcagaagggggaggagguccaggugaucgccgucgagcccggcaagaacccgaagaacuuccagaccaugcccggcaucuuccagaccacgaccggggagaucggcgccaucgcgcuggacuucaagcccgggaccagcggcuccccgaucaucaaccgcgagggcaaggugguggggcuguacggcaacggggucgugaccaagaacggcggguacgugagcggcaucgcccagacgaacgccgagcccgacggccccacccccgagcucgaggaggagauguucaagaagcggaaccugaccaucauggaccugcacccgggguccggcaagacccgcaaguaccuccccgccaucguccgggaggccaucaagcgccggcugcgcacgcugauccucgcgcccacccgggugguggccgccgagauggaggaggcccugaaggggcugcccauccgcuaccagaccaccgccaccaagagcgagcacaccggccgggagaucgucgaccucaugugccacgcgaccuucaccaugcgccugcuguccccggugcgggugcccaacuacaaccucgucaucauggacgaggcccacuucacggaccccgccagcaucgccgcccgcggguacaucuccacccgggugggcaugggcgaggcggccgccaucuucaugaccgccacgccgcccgggacggcggaggccuucccccagagcaacgcccccauccaggacgaggagcgcgacauccccgagcgcuccuggaacagcggcaacgaguggaucaccgacuucguggggaagaccgucugguucgugcccuccaucaaggccggcaacgacaucgccaacugccugcggaagaacgggaagaaggugauccagcugagccgcaagaccuucgacacggaguaccagaagacccggcucaacgacugggacuucgucgugaccaccgacaucuccgagaugggcgcgaacuucaaggccgaccgcgugaucgacccccggcgcugccugaagcccgucauccugacggacggccccgagcgggugauccucgccgggccgaugcccgugaccgccgccagcgcggcccagcgccggggccgcgucgggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagagccgcaagacguucguggagcucaugcggcgcggggaccugcccgucuggcuggcccacaagguggccuccgagggcaucaaguacaccgaccggaaguggugcuucgacggggagcgcaacaaccagauccucgaggagaacauggacguggagaucuggaccaaggagggcgagcggaagaagcugcgcccgcgcuggcuggacgcgcggaccuacagcgacccccucgcccugaaggaguucaaggacuucgccgccggccgcaaguccaucgcccuggaccucgucacggagaucgggcgggugcccagccaccuggcgcaccgcacccggaacgcccuggacaaccucgugaugcugcacaccagcgagcacggcgggcgcgccuaccggcacgccgucgaggagcugccggagaccauggagacgcuccugcugcucggccugaugauccugcucaccgggggcgccaugcuguuccugaucuccggcaaggggaucggcaagaccagcaucgggcucaucugcgugaucguguccagcggcaugcuguggauggcggacgucccccugcaguggaucgccuccgccaucgugcucgaguucuucaugauggugcugcugauccccgagcccgagaagcagcgcaccccgcaggacaaccagcucgccuacgucgugaucgggauccugacgcuggccgcgaucguggccgccaacgagaugggccuccuggagaccaccaagcgggaccugggcaugagcaaggagcccggggucgugucccccaccagcuaccucgacguggaccugcaccccgccuccgccuggacgcuguacgcggucgccaccaccgugaucaccccgaugcuccgccacacgaucgagaacagcaccgccaacgugucccuggccgcgaucgccaaccaggccgucgugcugaugggccucgacaagggguggcccaucagcaagauggaccugggcgugccccugcucgcccuggggugcuacucccaggucaacccccugacccucaccgccgcggugcugcugcucgugacgcacuacgccaucaucggcccgggccugcaggccaaggccacccgggaggcccagaagcgcaccgcggccgggaucaugaagaaccccaccgucgacggcaucaugacgaucgaccuggaccccgugaucuacgacagcaaguucgagaagcagcucggccaggugaugcugcugguccucugcgccgugcagcugcugcucaugcggaccuccugggcccugugcgaggcccugacccucgcgaccggccccaucacgacccugugggagggcagcccggggaaguucuggaacaccaccaucgccguguccauggccaacaucuuccgcggcagcuaccuggccggggcgggccucgccuucuccaucaugaaguccgucgggacgggccggcgcggcaccgggagccagggcgagacccugggggagaaguggaagaagaagcugaaccagcucucccggaaggaguucgaccuguacaagaaguccggcaucaccgagguggaccgcaccgaggccaaggaggggcugaagcggggcgagacgacccaccacgccgugucccgcggcagcgccaagcuccagugguucgucgagcggaacauggugauccccgaggggcgcgugaucgaccugggcugcgggcgcggcgggugguccuacuacugcgcgggccugaagaaggucaccgaggugcggggcuacaccaagggcgggcccgggcacgaggagcccgugccgaugagcacguacggcuggaacaucgucaagcucauguccgggaaggacguguucuaccugccgcccgagaagugcgacacccugcugugcgacaucggcgagagcucccccagcccgaccguggaggagucccgcaccauccggguccucaagaugguggagcccuggcugcgcaacaaccaguucugcaucaaggugcugaaccccuacaugcccacggucaucgagcaccucgagcggcugcagcgcaaguacggcgggaugcuggugcggaacccgcucagccgcaacuccacccacgagauguacuggaucagcaacggcaccgggaacaucguguccagcgucaacauggugucccggcugcugcucaaccgcuucaccaugacgcaccggcgccccaccaucgagaaggacgucgaccugggcgccggcacccggcacgugaacgccgagcccgagaccccgaacauggacgugaucggggagcgcaucaagcggaucaaggaggagcacagcuccacguggcacuacgacgacgagaaccccuacaagaccugggccuaccacggcagcuacgaggucaaggccaccgggagcgcguccagcaugaucaacggcguggugaagcugcucaccaagcccugggacgucgugcccauggugacgcagauggccaugaccgacaccaccccguucgggcagcagcgcgucuucaaggagaagguggacacgcggacgccccggcccaugcccggcacccggaaggugauggagaucaccgccgaguggcuguggcgcacgcugggccgcaacaagaagccgcggcucugcacccgcgaggaguucaccaagaagguccggaccaacgccgccaugggggcgguguucacggaggagaaccagugggacuccgcccgcgccgccguggaggacgaggaguucuggaagcuggucgaccgggagcgcgagcugcacaagcucggcaagugcgggagcugcguguacaacaugaugggcaagcgggagaagaagcugggggaguucggcaaggcgaagggcucccgcgccaucugguacauguggcugggggcccgguaccucgaguucgaggcccugggcuuccugaacgaggaccacugguucagccgcgagaacuccuacagcgggguggagggcgaggggcuccacaagcugggcuacauccugcgggacaucuccaagauccccggcggggccauguacgcggacgacaccgccggcugggacacccgcaucaccgaggacgaccuccacaacgaggagaagaucacgcagcagauggaccccgagcaccggcagcuggccaacgccaucuucaagcugaccuaccagaacaaggucgugaaggugcagcgccccaccccgaaggggaccgucauggacaucaucagccggaaggaccagcgcggcuccggccagguggggaccuacggccucaacacguucaccaacauggaggcccagcuggugcggcagauggagggggagggcguccugagcaaggcggaccucgagaacccccaccuccuggagaagaagaucacccaguggcucgagaccaaggggguggagcgccugaagcggauggccaucuccggcgacgacugcguggucaagcccaucgacgaccgcuucgccaacgcccugcucgcccugaacgacaugggcaaggugcggaaggacaucccccaguggcagccgagcaagggguggcacgacuggcagcagguccccuucugcucccaccacuuccacgagcugaucaugaaggacggccgcaagcucgucgugcccugccgcccccaggacgagcugaucgggcgggcgcgcaucagccagggcgccggguggucccugaaggagacggccugccucggcaaggccuacgcccagauguggagccugauguacuuccaccggcgcgaccugcggcucgcguccaacgccaucugcagcgccgugccgguccacuggauccccaccagccgcaccaccugguccauccacgcccaccaccaguggaugacgaccgaggacaugcugaccguguggaaccggguguggaucgaggacaaccccuggauggaggacaagacccccgucacgaccugggaggacgugccguaccugggcaagcgcgaggaccaguggugcgggagccucaucggccugaccucccgggcgaccugggcccagaacauccugacggccauccagcagguccgcagccucaucggggacgaggaguuccuggacuacaugcccuccaugaagcgguuccgcaaggaggaggagagcgagggcgccaucugguga

SEQ ID NO: 9938 - RNA, 9873 nt, Artificial Sequence
  derived and/or modified CDS sequence (opt1) from DENV-3__GU131916__SS-prME
accagccugugccucaugaugaugcugcccgccacccuggccuuccaccucaccagccgggacggcgagccccggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacacguggaccgagcaguacaaguuccaggccgacagccccaagcgccuggcgaccgccaucgccggcgccugggagaacggggugugcggcauccgcuccaccacgcggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacagcuggaagacgugggggaaggcgaagaucgugaccgccgagacccagaacuccagcuucaucaucgacggccccaacacccccgagugccccuccgccagccgggccuggaacgugugggaggucgaggacuacggguucggcguguucacgaccaacaucuggcugaagcuccgcgagguguacacccagagcugcgaccaccggcugauguccgcggccaucaaggacgagcgcgccguccacgccgacaugggcuacuggaucgagagccagaagaacggguccuggaagcuggagaaggccagcuucaucgaggugaagaccugcaccuggccgaagucccacacgcucuggagcaacggcgugcuggaguccgacaugaucauccccaagagccuggcggggcccaucucccagcacaaccaccggccgggcuaccacacccagaccgccgggcccuggcaccucggcaagcuggagcuggacuucaacuacugcgagggcaccacggucgugaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucaacgagaaggaggagaacauggucaagucccuggugagcgccggcuccgggaagguggacaacuucaccaugggcguccugugccucgccauccuguucgaggaggugaugcgggggaaguucggcaagaagcacaugaucgccggggugcuguucacguucguccuccugcugagcggccagaucaccuggcgcgacauggcgcacacccucaucaugaucggcuccaacgccagcgaccggauggggaugggcgugaccuaccuggcccugaucgccacguucaagauccagcccuuccucgcccugggguucuuccugcgcaagcucaccagccgggagaaccugcugcucggcgugggccuggcgauggccaccacccugcagcuccccgaggacaucgagcagauggccaacgggaucgcccugggccugaugacgcucaagcugaucacccaguucgagaccuaccagcuguggaccgcgcucgucucccugacgugcagcaacaccaucuucacccugaccguggccuggcgcacggccacccucauccuggccggggucucccugcucccgcugugccagagcuccagcaugcggaagaccgacuggcugcccaugaccguggccgcgaugggcgugccgccccugccgcuguucaucuucucccugaaggacacgcccaagcgccgcagcuggccccucaacgagggggucauggccgugggccugguguccauccuggccagcucccuccugcggaacgacguccccauggccggcccgcugguggccgggggccuccugaucgcgugcuacgugaucaccgggaccagcgccgaccugaccgucgagaaggccgccgacgugacgugggaggaggaggccgagcagaccggcgugucccacaaccucaugaucaccgucgacgacgacgggaccaugcgcaucaaggacgacgagaccgagaacauccugacggugcugcucaagaccgcgcugcugaucgugagcggcaucuuccccuacuccauccccgccacccuccuggucuggcacaccuggcagaagcagacgcagcggagcggcgugcugugggacgugcccuccccgcccgagacccagaaggccgagcucgaggagggggucuaccgcaucaagcagcagggcaucuucgggaagacccaggugggcguggggguccagaaggagggcguguuccacaccauguggcacgugacgcggggcgccguccugacccacaacgggaagcgccuggagcccaacugggccagcgugaagaaggaccucaucuccuacggcgggggcuggcggcugagcgcgcaguggcagaagggggaggaggugcaggucaucgccguggagcccggcaagaacccgaagaacuuccagaccaugcccggcaucuuccagaccacgaccggggagaucggcgccaucgcccuggacuucaagcccgggaccagcggcuccccgaucaucaaccgcgagggcaagguggucgggcuguacggcaacggggugaucaccaagaacggcggguacgugagcggcaucgcgcagacgaacgccgagcccgacggccccacccccgagcucgaggaggagauguucaagaagcggaaccugaccaucauggaccugcacccgggguccggcaagacccgcaaguaccuccccgccaucguccgggaggccaucaagcgccggcugcgcacgcugauccucgcccccacccgggugguggcggccgagauggaggaggcccugaaggggcugcccauccgcuaccagaccaccgccaccaagagcgagcacaccggccgggagaucgucgaccucaugugccacgccaccuucaccaugcgccugcuguccccggugcgggugcccaacuacaaccucgucaucauggacgaggcgcacuucacggaccccgccagcaucgccgcccgcggguacaucuccacccgggugggcaugggcgaggccgcggccaucuucaugaccgccacgccgcccgggacggccgaggcguucccccagagcaacgcccccauccaggacgaggagcgcgacauccccgagcgcuccuggaacagcggcaacgaguggaucaccgacuucguggggaagaccgucugguucgugcccuccaucaaggccggcaacgacaucgccaacugccugcggaagaacgggaagaaggugauccagcugagccgcaagaccuucgacacggaguaccagaagacccggcucaacgacugggacuucgucgugaccaccgacaucuccgagaugggcgccaacuucaaggcggaccgcgugaucgacccccggcgcugccugaagcccgucauccugacggacggccccgagcgggugauccucgccgggccgaugcccgugaccgccgccagcgccgcgcagcgccggggccgcgucgggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgccgcgaucgacggcgaguaccggcugaagggcgagagccgcaagacguucguggagcucaugcggcgcggggaccugcccgucuggcuggcccacaagguggccuccgagggcaucaaguacaccgaccggaaguggugcuucgacggggagcgcaacaaccagauccucgaggagaacauggacguggagaucuggaccaaggagggcgagcggaagaagcugcgcccgcgcuggcuggacgcccggaccuacagcgacccccucgcgcugaaggaguucaaggacuucgccgccggccgcaaguccaucgcccuggaccucgucacggagaucgggcgggugcccagccaccuggcccaccgcacccggaacgcgcuggacaaccucgugaugcugcacaccagcgagcacggcgggcgcgccuaccggcacgccgucgaggagcugccggagaccauggagacgcuccugcugcucggccugaugauccugcucaccuccggggccaugcuguuccugaucagcggcaagggcaucgggaagaccuccaucggccucaucugcgugaucgugagcuccgggaugcuguggauggccgacgucccccugcaguggaucgcgagcgccaucgugcucgaguucuucaugauggugcugcugauccccgagcccgagaagcagcgcaccccgcaggacaaccagcucgccuacgucgugaucggcauccugacgcuggccgccaucguggcggccaacgagauggggcuccuggagaccaccaagcgggaccugggcauguccaaggagcccggcgucgugagccccaccuccuaccucgacguggaccugcaccccgccagcgccuggacgcuguacgccgucgcgaccaccgugaucaccccgaugcuccgccacacgaucgagaacuccaccgccaacgugagccuggccgccaucgcgaaccaggccgucgugcugauggggcucgacaagggcuggcccaucuccaagauggaccugggggugccccugcucgcccugggcugcuacagccaggucaacccccugacccucaccgccgccgugcugcugcucgugacgcacuacgcgaucaucgggccgggccugcaggccaaggccacccgggaggcccagaagcgcaccgccgcgggcaucaugaagaaccccaccgucgacgggaucaugacgaucgaccuggaccccgugaucuacgacuccaaguucgagaagcagcucggccaggugaugcugcugguccucugcgccgugcagcugcugcucaugcggaccagcugggcccugugcgaggcccugacccucgccaccgggcccaucacgacccugugggagggcuccccgggcaaguucuggaacaccaccaucgcggugagcauggccaacaucuuccgcggguccuaccuggccggcgccgggcucgcguucagcaucaugaaguccgucggcacggggcggcgcggcaccggcucccagggggagacccugggcgagaaguggaagaagaagcugaaccagcucagccggaaggaguucgaccuguacaagaaguccgggaucaccgagguggaccgcaccgaggccaaggagggccugaagcgcggggagacgacccaccacgccgugagccgcggcuccgccaagcuccagugguucgucgagcggaacauggugauccccgagggccgcgugaucgaccuggggugcggccgcgggggcuggagcuacuacugcgccgggcugaagaaggucaccgaggugcggggcuacaccaagggcgggcccggccacgaggagcccgugccgauguccacguacggguggaacaucgucaagcucaugagcggcaaggacguguucuaccugccgcccgagaagugcgacacccugcugugcgacaucggggaguccagccccuccccgaccguggaggagagccgcaccauccggguccucaagaugguggagcccuggcugcgcaacaaccaguucugcaucaaggugcugaaccccuacaugcccacggucaucgagcaccucgagcggcugcagcgcaaguacggcggcaugcuggugcggaacccgcucucccgcaacagcacccacgagauguacuggaucuccaacgggaccggcaacaucgugagcuccgucaacauggugagccggcugcugcucaaccgcuucaccaugacgcaccggcgccccaccaucgagaaggacgucgaccugggggcgggcacccggcacgugaacgccgagcccgagaccccgaacauggacgugaucggcgagcgcaucaagcggaucaaggaggagcacuccagcacguggcacuacgacgacgagaaccccuacaagaccugggccuaccacgggagcuacgaggucaaggccaccggcuccgccagcuccaugaucaacgggguggugaagcugcucaccaagcccugggacgucgugcccauggugacgcagauggcgaugaccgacaccaccccguucggccagcagcgcgucuucaaggagaagguggacacgcggacgccccggcccaugcccgggacccggaaggugauggagaucaccgccgaguggcuguggcgcacgcugggccgcaacaagaagccgcggcucugcacccgcgaggaguucaccaagaagguccggaccaacgccgccaugggcgccguguucacggaggagaaccagugggacagcgcgcgcgccgccguggaggacgaggaguucuggaagcuggucgaccgggagcgcgagcugcacaagcucgggaagugcggcuccugcguguacaacaugauggggaagcgggagaagaagcugggcgaguucgggaaggccaagggcagccgcgcgaucugguacauguggcugggcgcccgguaccucgaguucgaggcccugggguuccugaacgaggaccacugguucucccgcgagaacagcuacuccggcguggagggggagggccuccacaagcugggguacauccugcgggacaucagcaagauccccggcggcgccauguacgccgacgacaccgcggggugggacacccgcaucaccgaggacgaccuccacaacgaggagaagaucacgcagcagauggaccccgagcaccggcagcuggccaacgccaucuucaagcugaccuaccagaacaaggucgugaaggugcagcgccccaccccgaagggcaccgucauggacaucaucucccggaaggaccagcgcgggagcggccaggugggcaccuacgggcucaacacguucaccaacauggaggcccagcuggugcggcagauggagggcgaggacguccuguccaaggccgaccucgagaacccccaccuccuggagaagaagaucacccaguggcucgagaccaaggggguggagcgccugaagcggauggcgaucagcggcgacgacugcguggucaagcccaucgacgaccgcuucgccaacgcccugcucgcccugaacgacauggggaaggugcggaaggacaucccccaguggcagccguccaagggcuggcacgacuggcagcagguccccuucugcagccaccacuuccacgagcugaucaugaaggacggccgcaagcucgucgugcccugccgcccccaggacgagcugaucgggcgggcccgcaucucccagggcgcgggguggagccugaaggagacggccugccucggcaaggccuacgcccagauguggucccugauguacuuccaccggcgcgaccugcggcucgccagcaacgcgaucugcagcgccgugccgguccacuggauccccaccucccgcaccaccuggagcauccacgcccaccaccaguggaugacgaccgaggacaugcugaccguguggaaccggguguggaucgaggacaaccccuggauggaggacaagacccccgucacgaccugggaggacgugccguaccuggggaagcgcgaggaccaguggugcggcucccucaucggccugaccagccgggccaccugggcgcagaacauccugacggccauccagcagguccgcucccucaucggggacgaggaguucagcgacuacaugcccuccaugaagcgguuccgcaaggaggaggagagcgagggcgccaucugguga

SEQ ID NO: 9939 - RNA, 9873 nt, Artificial Sequence
  derived and/or modified CDS sequence (opt1) from DENV-3__GU131917__SS-prME
accagccugugccucaugaugaugcugcccgcgacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgucaccuacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucacgcugcucaugcuggucacccccagcaugaccaugcggugcgugggggugggcaaccgcgacuucgucgagggccuguccggggccaccuggguggacgugguccucgagcacggcgggugcgugacgaccauggccaagagcaagcccacccuggacaucgagcugcagaagaccgaggccacgcagcucgcgacccugcggaagcugugcaucgagggcaagaucaccaacaucaccacggacucccgcugccccacccagggcgaggccacccucccggaggagcaggaccagaacuacgugugcaagcacaccuacgucgaccggggguggggcaacgggugcggccuguucgggaagggcagccuggugacgugcgccaaguuccagugccucgagcccaucgagggcaaggugguccaguacgagaaccugaaguacaccgugaucaucaccgugcacaccggggaccagcaccaggucggcaacgacacgcagggggugaccgucgagaucacgccccaggccuccaccguggaggccgugcugcccgaguacggcacccucgggcuggagugcagcccgcgcacgggccuggacuucaacgagaugauccuccugaccaugaagaacaaggcguggaugguccaccggcagugguucuucgaccugccccuccccuggaccuccggcgccaccacggagacccccaccuggaaccgcaaggagcugcuggugaccuucaagaacgcccacgccaagaagcaggagguggucgugcucgggagccaggagggcgccaugcacacggcgcugaccggggccaccgagauccagaacuccggcgggaccagcaucuucgccggccaccugaagugccggcucaagauggacaagcuggagcugaagggcauguccuacgccaugugccucaacacguucgugcugaagaaggaggucagcgagacccagcacgggaccauccugaucaagguggaguacaagggcgaggacgccccgugcaagauccccuucagcaccgaggacgggcagggcaaggcgcacaacggccgccugaucacggccaaccccguggucaccaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacacggcccuguucuccggcgucagcuggaucaugaagaucggcaucggggugcugcucaccuggaucggccugaacuccaagaacaccagcauguccuucagcugcaucgugaucgggaucaucacccuguaccucggcgccgucgugcaggccgacauggggugcgugaucaacuggaagggcaaggagcugaagugcggcaacgggaucuucgucacgaacgaggugcacaccuggaccgagcaguacaaguuccaggccgacucccccaagcgccuggcgaccgccaucgccggcgccugggagaacggggugugcggcauccgcagcacgacccggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacuccuggaagaccugggggaaggcgaagaucgugaccgccgagacccagaacagcuccuucaucaucgacggccccaacacgcccgagugccccagcgccucccgggccuggaacgugugggaggucgaggacuacggguucggcguguucaccaccaacaucuggcugaagcuccgcgagguguacacccagagcugcgaccaccggcugaugagcgcggccaucaaggacgagcgcgccguccacgccgacaugggcuacuggaucgagucccagaagaacgggagcuggaagcuggagaaggccuccuucaucgaggugaagaccugcacguggcccaagagccacacccucugguccaacggcgugcuggagagcgacaugaucauccccaagucccuggcggggcccaucagccagcacaaccaccggccgggcuaccacacccagaccgccgggcccuggcaccucggcaagcuggagcuggacuucaacuacugcgagggcacgaccgucgugaucgccgagaacugcgggacccgcggccccucccuccggaccacgaccgugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgcgggggugcuguucacguucguccuccugcuguccggccagaucaccuggcgcgacauggcccacacccucaucaugaucggcagcaacgccuccgaccggauggggaugggcgugaccuaccuggcccugaucgccacguucaagauccagcccuuccucgcgcugggguucuuccugcgcaagcucaccagccgggagaaccugcugcucggcgugggccuggccauggccaccacccugcagcuccccgaggacaucgagcagauggccaacgggaucgcgcugggccugaugacgcucaagcugaucacccaguucgagaccuaccagcuguggaccgcccucgucagccugacgugcuccaacaccaucuucacccugaccguggccuggcgcacggccacccucauccuggccggggucagccugcucccgcugugccaguccagcuccaugcggaagaccgacuggcugcccaugaccguggcggccaugggcgugccgccccugccgcuguucaucuucagccugaaggacacgcccaagcgccgcuccuggccccucaacgagggggucauggccgugggccuggugagcauccuggccuccagccuccugcggaacgacguccccauggccggcccgcugguggccggcgggcuccugaucgccugcuacgugaucaccgggaccuccgccgaccugaccgucgagaaggccgccgacgugacgugggaggaggaggcggagcagaccggggugagccacaaccucaugaucaccgucgacgacgacgggaccaugcgcaucaaggacgacgagaccgagaacauccugacggugcugcucaagaccgcccugcugaucguguccggcaucuuccccuacagcauccccgccacccuccuggucuggcacaccuggcagaagcagacgcagcgguccggcgugcugugggacgugcccagcccgcccgagacccagaaggccgagcucgaggagggggucuaccgcaucaagcagcagggcaucuucgggaagacccaggugggcguggggguccagaaggagggcguguuccacaccauguggcacgugacgcggggcgccguccugacccacaacgggaagcgccuggagcccaacugggcguccgugaagaaggaccucaucagcuacggcgggggcuggcggcuguccgcccaguggcagaagggggaggaggugcaggucaucgccguggagcccggcaagaacccgaagaacuuccagaccaugcccggcaucuuccagaccacgaccggggagaucggcgccaucgcgcuggacuucaagcccgggaccagcggcagcccgaucaucaaccgcgagggcaagguggucgggcuguacggcaacgggguggugaccaagaacggcggguacgucuccggcaucgcccagacgaacgccgagcccgacggccccacccccgagcucgaggaggagauguucaagaagcggaaccugaccaucauggaccugcacccggggagcggcaagacccgcaaguaccuccccgccaucgugcgggaggccaucaagcgccggcugcgcacgcugauccucgcgcccacccggguggucgccgccgagauggaggaggcccugaaggggcugcccauccgcuaccagaccaccgccacgaaguccgagcacaccggccgggagaucguggaccucaugugccacgcgaccuucaccaugcgccugcugagcccggugcggguccccaacuacaaccucgugaucauggacgaggcccacuucacggaccccgccuccaucgccgcccgcggguacaucagcacccgggugggcaugggcgaggcggccgccaucuucaugaccgccacgccgcccgggacggcggaggccuucccccaguccaacgcccccauccaggacgaggagcgcgacauccccgagcgcagcuggaacuccggcaacgaguggaucaccgacuucgucgggaagaccgugugguucgugcccagcaucaaggccggcaacgacaucgccaacugccugcggaagaacgggaagaaggucauccagcugucccgcaagaccuucgacacggaguaccagaagacccggcucaacgacugggacuucguggugaccaccgacaucagcgagaugggcgcgaacuucaaggccgaccgcgucaucgacccccggcgcugccugaagcccgugauccugacggacggccccgagcgggugauccucgccgggccgaugcccgucaccgccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagacguucgucgagcucaugcggcgcggggaccugcccguguggcuggcccacaagguggccagcgagggcaucaaguacaccgaccggaaguggugcuucgacggggagcgcaacaaccagauccucgaggagaacauggacgucgagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugacggagaucgggcgggugcccucccaccuggcgcaccgcacccggaacgcccuggacaaccucgucaugcugcacaccagcgagcacggcgggcgcgccuaccggcacgccguggaggagcugccggagaccauggagacgcuccugcugcucggccugaugauccugcucaccgggggcgccaugcuguuccugaucagcggcaaggggaucggcaagaccuccaucgggcucaucugcgugaucgucagcuccggcaugcuguggauggcggacgugccccugcaguggaucgccagcgccaucgugcucgaguucuucaugaugguccugcugauccccgagcccgagaagcagcgcaccccgcaggacaaccagcucgccuacguggugaucgggauccugacgcuggccgcgaucgucgccgccaacgagaugggccuccuggagaccaccaagcgggaccugggcauguccaaggagcccgggguggugagccccaccuccuaccucgacgucgaccugcaccccgccagcgccuggacgcuguacgcgguggccaccaccgugaucaccccgaugcuccgccacacgaucgagaacuccaccgccaacgucagccuggccgcgaucgccaaccaggccguggugcugaugggccucgacaagggguggcccaucuccaagauggaccugggcgucccccugcucgcccuggggugcuacagccaggugaacccccugacccucaccgccgcggugcugcugcucgucacgcacuacgccaucaucggcccgggccugcaggccaaggccacccgggaggcccagaagcgcaccgcggccgggaucaugaagaaccccaccguggacggcaucaugacgaucgaccuggaccccgugaucuacgacuccaaguucgagaagcagcucgggcaggucaugcugcuggugcucugcgccgugcagcugcugcucaugcggaccagcugggcccugugcgaggcccugacccucgcgaccggccccaucacgacccugugggagggcuccccggggaaguucuggaacaccaccaucgccgucagcauggccaacaucuuccgcggcuccuaccuggccggggcgggccucgccuucagcaucaugaaguccguggggacgggcaagcggggcaccgggagccagggcgagacccugggggagaaguggaagaagaagcugaaccagcucagccgcaaggaguucgaccuguacaagaaguccggcaucaccgagguggaccggagcgaggccaaggaggggcugaagcgcggcgagaccacgcaccacgccgucucccggggcagcgccaagcuccagugguucguggagcgcaacauggugauccccgaggggcgggucaucgaccugggcugcgggcgcggcgggugguccuacuacugcgcgggccugaagaaggugaccgaggugcgcggcuacaccaagggcggccccgggcacgaggagcccgucccgaugagcaccuacggcuggaacaucgugaagcucauguccgggaaggacguguucuaccugccgcccgagaagugcgacacgcugcugugcgacaucggcgagagcucccccagcccgaccgucgaggagucccggaccauccgcgugcucaagaugguggagcccuggcugcggaacaaccaguucugcaucaagguccugaaccccuacaugcccaccgugaucgagcaccucgagcgccugcagcggaaguacggcgggaugcuggugcgcaacccgcucagccggaacuccacgcacgagauguacuggaucagcaacggcaccgggaacaucgucuccagcgugaacauggucucccgccugcugcucaaccgguucaccaugacccaccgccggcccacgaucgagaaggacguggaccugggcgccggcacccgccacgugaacgccgagcccgagaccccgaacauggacgucaucggggagcggaucaagcgcaucaaggaggagcacagcuccaccuggcacuacgacgacgagaaccccuacaagacgugggccuaccacggcagcuacgaggugaaggccaccgggagcgcguccagcaugaucaacggcguggucaagcugcucaccaagcccugggacguggugcccauggucacccagauggccaugacggacaccaccccguucgggcagcagcggguguucaaggagaagguggacacccgcacgccccggcccaugcccggcacccgcaaggucauggagaucaccgccgaguggcuguggcggacccugggccgcaacaagaagccgcgccucugcacgcgggaggaguucaccaagaaggugcgcaccaacgccgccaugggggcgguguucaccgaggagaaccagugggacuccgcccgggccgccgucgaggacgaggaguucuggaagcugguggacaaggagcgcgagcugcacaagcucggcaagugcgggagcugcguguacaacaugaugggcaagcgggagaagaagcugggggaguucggcaaggcgaagggcucccgcgccaucugguacauguggcugggggcccgguaccucgaguucgaggcccugggcuuccugaacgaggaccacugguucagccgcgagaacuccuacagcggggucgagggcgaggggcuccacaagcugggcuacauccugcgggacaucuccaagauccccggcggggccauguacgcggacgacacggccggcugggacacccgcaucaccgaggacgaccuccacaacgaggagaagaucacccagcagauggaccccgagcaccggcagcuggccaacgccaucuucaagcugacguaccagaacaagguggugaagguccagcgccccaccccgaaggggaccgugauggacaucaucagccggaaggaccagcgcggcuccggccagguggggaccuacggccucaacaccuucacgaacauggaggcccagcugguccggcagauggagggggagggcgugcugagcaaggcggaccucgagaacccccaccuccuggagaagaagaucauccaguggcucgagaccaaggggguggagcgccugaagcggauggccaucuccggcgacgacugcgucgugaagcccaucgacgaccgcuucgccaacgcccugcucgcccugaacgacaugggcaaggugcggaaggacaucccccaguggcagccgagcaagggguggcacgacuggcagcagguccccuucugcucccaccacuuccacgagcugaucaugaaggacggccgcaagcucguggugcccugccggccccaggacgagcugaucgggcgcgcgcgcaucagccagggcgccggguggucccugaaggagaccgccugccucggcaaggccuacgcccagauguggagccugauguacuuccaccggcgcgaccugcggcucgcguccaacgccaucugcagcgccgucccggugcacuggauccccaccagccgcacgaccugguccauccacgcccaccaccaguggaugaccaccgaggacaugcugagcguguggaaccgggucuggaucgaggacaaccccuggauggaggacaagacgcccgugaccaccugggaggacgugccguaccugggcaagcgcgaggaccaguggugcgggucccucaucggccugaccagccgggcgacgugggcccagaacauccugaccgccauccagcagguccgcucccucaucggggacgaggaguuccuggacuacaugcccagcaugaagcgguuccgcaaggaggaggaguccgagggcgccaucugguga

SEQ ID NO: 9940 - RNA, 9873 nt, Artificial Sequence
  derived and/or modified CDS sequence (opt1) from DENV-3__GU131918__SS-prME
accagccugugccucaugaugaugcugcccgccacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgucaccuacaagugcccccugaucgccgagguggagcccgaggacaucgacugcuggugcaaccucaccagcaccugggugaccuacgggaccugcaaccaggccggcgagcaccggcgcgacaagcgguccgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcaacgggaucuucgucaccaacgaggugcacacguggaccgagcaguacaaguuccaggccgacucccccaagcgccuggcgaccgccaucgccggcgccugggagaacggggugugcggcauccgcagcaccacgcggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacuccuggaagacgugggggaaggcgaagaucgugaccgccgagacccagaacagcuccuucaucaucgacggccccaacacccccgagugccccagcgccucccgggccuggaacgugugggaggucgaggacuacggguucggcguguucacgaccaacaucuggcugaagcuccgcgagguguacacccagagcugcgaccaccggcugaugagcgcggccaucaaggacgagcgcgccguccacgccgacaugggcuacuggaucgagucccagaagaacgggagcuggaagcuggagaaggccuccuucaucgaggugaagaccugcaccuggcccaagagccacacgcucugguccaacggcgugcuggagagcgacaugaucauccccaagucccuggcggggcccaucagccagcacaaccaccggccgggcuaccacacccagaccgccgggcccuggcaccucggcaagcuggagcuggacuucaacuacugcgagggcaccacggucgugaucaccgagaacugcgggacccgcggccccucccuccggaccacgaccgugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgccggggugcuguucacguucguccuccugcuguccggccagaucaccuggcgcgacauggcgcacacccucaucaugaucggcagcaacgccuccgaccggauggggaugggcgugaccuaccuggcccugaucgccacguucaagauccagcccuuccucgcccugggguucuuccugcgcaagcucaccagccgggagaaccugcugcucggcgugggccuggcgauggccaccacccugcagcuccccgaggacaucgagcagauggccaacgggaucgcccugggccugaugacgcucaagcugaucacccaguucgagaccuaccagcuguggaccgcgcucgucagccugacgugcuccaacaccaucuucacccugaccguggccuggcgcacggccacccucauccuggccggggucagccugcucccgcugugccaguccagcuccaugcggaagaccgacuggcugcccaugaccguggccgcgaugggcgugccgccccugccgcuguucaucuucagccugaaggacacgcccaagcgccgcuccuggccccucaacgagggggucauggccgugggccuggugagcauccuggccuccagccuccugcggaacgacguccccauggccggcccgcugguggccgggggccuccugaucgcgugcuacgugaucaccgggaccuccgccgaccugaccgucgagaaggccgccgacgugacgugggaggaggaggccgagcagaccggcgugagccacaaccucaugaucaccgucgacgacgacgggaccaugcgcaucaaggacgacgagaccgagaacauccugacggugcugcucaagaccgcgcugcugaucguguccggcaucuuccccuacagcauccccgccacccuccuggucuggcacaccuggcagaagcagacgcagcgguccggcgugcugugggacgugcccagcccgcccgagacccagaaggccgagcucgaggagggggucuaccgcaucaagcagcagggcaucuucgggaagacccaggugggcguggggguccagaaggagggcguguuccacaccauguggcacgugacgcggggcgccguccugacccacaacgggaagcgccuggagcccaacugggccuccgugaagaaggaccucaucagcuacggcgggggcuggcggcuguccgcgcaguggcagaagggggaggaggugcaggucaucgccguggagcccggcaagaacccgaagaacuuccagaccaugcccggcaucuuccagaccacgaccggggagaucggcgccaucgcccuggacuucaagcccgggaccagcggcagcccgaucaucaaccgcgagggcaagguggucgggcuguacggcaacgggguggugaccaagaacggcggguacgucuccggcaucgcgcagacgaacgccgagcccgacggccccacccccgagcucgaggaggagauguucaagaagcggaaccugaccaucauggaccugcacccggggagcggcaagacccgcaaguaccuccccgccaucgugcgggaggccaucaagcgccggcugcgcacgcugauccucgcccccacccggguggucgcggccgagauggaggaggcccugaaggggcugcccauccgcuaccagaccaccgccacgaaguccgagcacaccggccgggagaucguggaccucaugugccacgccaccuucaccaugcgccugcugagcccggugcggguccccaacuacaaccucgugaucauggacgaggcgcacuucacggaccccgccuccaucgccgcccgcggguacaucagcacccgggugggcaugggcgaggccgcggccaucuucaugaccgccacgccgcccgggacggccgaggcguucccccaguccaacgcccccauccaggacgaggagcgcgacauccccgagcgcagcuggaacuccggcaacgaguggaucaccgacuucgucgggaagaccgugugguucgugcccagcaucaaggccggcaacgacaucgccaacugccugcggaagaacgggaagaaggucauccagcugucccgcaagaccuucgacacggaguaccagaagacccggcucaacgacugggacuucguggugaccaccgacaucagcgagaugggcgccaacuucaaggcggaccgcgucaucgacccccggcgcugccugaagcccgugauccugacggacggccccgagcgggugauccucgccgggccgaugcccgucaccgccgccuccgccgcgcagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgccgcgaucgacggcgaguaccggcugaagggcgagucccgcaagacguucgucgagcucaugcggcgcggggaccugcccguguggcuggcccacaagguggccagcgagggcaucaaguacaccgaccggaaguggugcuucgacggggagcgcaacaaccagauccucgaggagaacauggacgucgagaucuggaccaaggagggcgagcggaagaagcugcgcccgcgcuggcuggacgcccggaccuacuccgacccccucgcgcugaaggaguucaaggacuucgccgccggccgcaagagcaucgcccuggaccucgugacggagaucgggcgggugcccucccaccuggcccaccgcacccggaacgcgcuggacaaccucgucaugcugcacaccagcgagcacggcgggcgcgccuaccggcacgccguggaggagcugccggagaccauggagacgcuccugcugcucggccugaugauccugcucaccgggggcgccaugcuguuccugaucagcggcaaggggaucggcaagaccuccaucgggcucaucugcgugaucgucagcuccggcaugcuguggauggccgacgugccccugcaguggaucgcgagcgccaucgugcucgaguucuucaugaugguccugcugauccccgagcccgagaagcagcgcaccccgcaggacaaccagcucgccuacguggugaucgggauccugacgcuggccgccaucgucgcggccaacgagaugggccuccuggagaccaccaagcgggaccugggcauguccaaggagcccgggguggugagccccaccuccuaccucgacgucgaccugcaccccgccagcgccuggacgcuguacgccguggcgaccaccgugaucaccccgaugcuccgccacacgaucgagaacuccaccgccaacgucagccuggccgccaucgcgaaccaggccguggugcugaugggccucgacaagggguggcccaucuccaagauggaccugggcgucccccugcucgcccuggggugcuacagccaggugaacccccugacccucaccgccgccgugcugcugcucgucacgcacuacgcgaucaucggcccgggccugcaggccaaggccacccgggaggcccagaagcgcaccgccgcggggaucaugaagaaccccaccguggacggcaucaugacgaucgaccuggaccccgugaucuacgacuccaaguucgagaagcagcucgggcaggucaugcugcuggugcucugcgccgugcagcugcugcucaugcggaccagcugggcccugugcgaggcccugacccucgccaccggccccaucacgacccugugggagggcuccccggggaaguucuggaacaccaccaucgcggucagcauggccaacaucuuccgcggcuccuaccuggccggggccggccucgcguucagcaucaugaaguccguggggacgggcaagcggggcaccgggagccagggcgagacccugggggagaaguggaagaagaagcugaaccagcucagccgcaaggaguucgaccuguacaagaaguccggcaucaccgagguggaccggagcgaggccaaggaggggcugaagcgcggcgagaccacgcaccacgccgucucccggggcagcgccaagcuccagugguucguggagcgcaacauggugauccccgaggggcgggucaucgaccugggcugcgggcgcggcgggugguccuacuacugcgccggccugaagaaggugaccgaggugcgcggcuacaccaagggcgggcccgggcacgaggagcccgucccgaugagcaccuacggcuggaacaucgugaagcucauguccgggaaggacguguucuaccugccgcccgagaagugcgacacgcugcugugcgacaucggcgagagcucccccagcccgaccgucgaggagucccggaccauccgcgugcucaagaugguggagcccuggcugcggaacaaccaguucugcaucaagguccugaaccccuacaugcccaccgugaucgagcaccucgagcgccugcagcggaaguacggcgggaugcuggugcgcaacccgcucagccggaacuccacgcacgagauguacuggaucagcaacggcaccgggaacaucgucuccagcgugaacauggucucccgccugcugcucaaccgguucaccaugacccaccgccggcccacgaucgagaaggacguggaccugggcgcgggcacccgccacgugaacgccgagcccgagaccccgaacauggacgucaucggggagcggaucaagcgcaucaaggaggagcacagcuccaccuggcacuacgacgacgagaaccccuacaagacgugggccuaccacggcagcuacgaggugaaggccaccgggagcgccuccagcaugaucaacggcguggucaagcugcucaccaagcccugggacguggugcccauggucacccagauggcgaugacggacaccaccccguucgggcagcagcggguguucaaggagaagguggacacccgcacgccccggcccaugcccggcacccgcaaggucauggagaucaccgccgaguggcuguggcggacccugggccgcaacaagaagccgcgccucugcacgcgggaggaguucaccaagaaggugcgcaccaacgccgccaugggggccguguucaccgaggagaaccagugggacuccgcgcgggccgccgucgaggacgaggaguucuggaagcugguggacaaggagcgcgagcugcacaagcucggcaagugcgggagcugcguguacaacaugaugggcaagcgggagaagaagcugggggaguucggcaaggccaagggcucccgcgcgaucugguacauguggcugggggcccgguaccucgaguucgaggcccugggcuuccugaacgaggaccacugguucagccgcgagaacuccuacagcggggucgagggcgaggggcuccacaagcugggcuacauccugcgggacaucuccaagauccccggcggggccauguacgccgacgacacggcgggcugggacacccgcaucaccgaggacgaccuccacaacgaggagaagaucacccagcagauggaccccgagcaccggcagcuggccaacgccaucuucaagcugacguaccagaacaagguggugaagguccagcgccccaccccgaaggggaccgugauggacaucaucagccggaaggaccagcgcggcuccggccagguggggaccuacggccucaacaccuucacgaacauggaggcccagcugguccggcagauggagggggagggcgugcugagcaaggccgaccucgagaacccccaccuccuggagaagaagaucauccaguggcucgagaccaaggggguggagcgccugaagcggauggcgaucuccggcgacgacugcgucgugaagcccaucgacgaccgcuucgccaacgcccugcucgcccugaacgacaugggcaaggugcggaaggacaucccccaguggcagccgagcaagggguggcacgacuggcagcagguccccuucugcucccaccacuuccacgagcugaucaugaaggacggccgcaagcucguggugcccugccggccccaggacgagcugaucgggcgcgcccgcaucagccagggcgcgggguggucccugaaggagaccgccugccucggcaaggccuacgcccagauguggagccugauguacuuccaccggcgcgaccugcggcucgccuccaacgcgaucugcagcgccgucccggugcacuggauccccaccagccgcacgaccugguccauccacgcccaccaccaguggaugaccaccgaggacaugcugagcguguggaaccgggucuggaucgaggacaaccccuggauggaggacaagacgcccgugaccaccugggaggacgugccguaccugggcaagcgcgaggaccaguggugcgggucccucaucggccugaccagccgggccacgugggcgcagaacauccugaccgccauccagcagguccgcucccucaucggggacgaggaguuccuggacuacaugcccagcaugaagcgguuccgcaaggaggaggaguccgagggcgccaucugguga

SEQ ID NO: 9941 - RNA, 9873 nt, Artificial Sequence
  derived and/or modified CDS sequence (opt1) from DENV-3__GU131933__SS-prME
accagccugugccucaugaugaugcugcccgccacccuggccuuccaccucaccagccgggacggcgagccgcggaugaucguggggaagaacgagcgcggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacacguggaccgagcaguacaaguuccaggccgacagccccaagcgccuggcgaccgccaucgccggcgccugggagaacggggugugcggcauccgcuccaccacgcggauggagaaccuccuguggaagcagaucgccaacgagcugaacuacauccucugggagaacagcaucaagcugaccgucguggugggggacaucaucggcguccuggagcagggcaagcgcacccucacgccccagccgauggagcugaaguacuccuggaagacgugggggaaggcgaagaucgugaccgccgagacccagaacagcuccuucaucaucgacggccccaacacccccgagugccccagcgccagccgggccuggaacgugugggaggucgaggacuacggguucggcguguucacgaccaacaucuggcugaagcuccgcgagguguacacccaguccugcgaccaccggcugaugagcgcggccaucaaggacgagcgcgccguccacgccgacaugggcuacuggaucgagucccagaagaacgggagcuggaagcuggagaaggccuccuucaucgaggugaagaccugcaccuggcccaagagccacacgcucugguccaacggcgugcuggagagcgacaugaucauccccaagucccuggcggggcccaucagccagcacaaccaccggccgggcuaccacacccagaccgccgggcccuggcaccucggcaagcuggagcuggacuucaacuacugcgagggcaccacggucgugaucaccgagaacugcgggacccgcggccccucccuccggaccacgaccgugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgccggggugcuguucacguucguccuccugcuguccggccagaucaccuggcgcgacauggcgcacacccucaucaugaucggcagcaacgccagcgaccggauggggaugggcgugaccuaccuggcccugaucgccacguucaagauccagcccuuccucgcccugggguucuuccugcgcaagcucaccucccgggagaaccugcugcucggcgugggccuggcgauggccaccacccugcagcuccccgaggacaucgagcagauggccaacgggaucgcccugggccugaugacgcucaagcugaucacccaguucgagaccuaccagcuguggaccgcgcucgucagccugacgugcuccaacaccaucuucacccugaccguggccuggcgcacggccacccucauccuggccggggucagccugcucccgcugugccaguccagcuccaugcggaagaccgacuggcugcccaugaccguggccgcgaugggcgugccgccccugccgcuguucaucuucagccugaaggacacgcccaagcgccgcuccuggccccucaacgagggggucauggccgugggccuggugagcauccuggccuccagccuccugcggaacgacguccccauggccggcccgcugguggccgggggccuccugaucgcgugcuacgugaucaccgggaccuccgccgaccugaccgucgagaaggccgccgacgugacgugggaggaggaggccgagcagaccggcgugagccacaaccucaugaucaccgucgacgacgacgggaccaugcgcaucaaggacgacgagaccgagaacauccugacggugcugcucaagaccgcgcugcugaucguguccggcaucuuccccuacagcauccccgccacccuccuggucuggcacaccuggcagaagcagacgcagcgguccggcgugcugugggacgugcccagcccgcccgagacccagaaggccgagcucgaggagggggucuaccgcaucaagcagcagggcaucuucgggaagacccaggugggcguggggguccagaaggagggcguguuccacaccauguggcacgugacgcggggcgccguccugacccacaacgggaagcgccuggagcccaacugggccuccgugaagaaggaccucaucagcuacggcgggggcuggcggcugagcgcgcaguggcagaagggggaggaggugcaggucaucgccguggagcccggcaagaacccgaagaacuuccagaccaugcccggcaucuuccagaccacgaugggggagaucggcgccaucgcccuggacuucaagcccgggaccuccggcagcccgaucaucaaccgcgagggcaagguggucgggcuguacggcaacgggguggugaccaagaacggcggguacgucuccggcaucgcgcagaccaacgccgagcccgacggccccacgcccgagcucgaggaggagauguucaagaagcggaaccugaccaucauggaccugcacccggggagcggcaagacccgcaaguaccuccccgccaucgugcgggaggccaucaagcgccggcugcgcacccugauccucgcccccacgcggguggucgcggccgagauggaggaggcccugaaggggcugcccauccgcuaccagaccaccgccaccaaguccgagcacacgggccgggagaucguggaccucaugugccacgccaccuucaccaugcgccugcugagcccggugcggguccccaacuacaaccucgugaucauggacgaggcgcacuucaccgaccccgccuccaucgccgcccgcggguacaucagcacgcgggugggcaugggcgaggccgcggccaucuucaugaccgccacgccgcccgggaccgccgaggcguucccccaguccaacgcccccauccaggacgaggagcgcgacauccccgagcgcagcuggaacuccggcaacgaguggaucacggacuucgucgggaagaccgugugguucgugcccagcaucaaggccggcaacgacaucgccaacugccugcggaagaacgggaagaaggucauccagcugucccgcaagaccuucgacaccgaguaccagaagacgcggcucaacgacugggacuucguggugaccaccgacaucagcgagaugggcgccaacuucaaggcggaccgcgucaucgacccccggcgcugccugaagcccgugauccugaccgacggccccgagcgggugauccucgccgggccgaugcccgucacggccgccuccgccgcgcagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgccgcgaucgacggcgaguaccggcugaagggcgagucccgcaagaccuucgucgagcucaugcggcgcggggaccugcccguguggcuggcccacaagguggccagcgagggcaucaaguacacggaccggaaguggugcuucgacggggagcgcaacaaccagauccucgaggagaacauggacgucgagaucuggaccaaggagggcgagcggaagaagcugcgcccgcgcuggcuggacgcccggaccuacuccgacccccucgcgcugaaggaguucaaggacuucgccgccggccgcaagagcaucgcccuggaccucgugaccgagaucgggcgggugcccagccaccuggcccaccgcacgcggaacgcgcuggacaaccucgucaugcugcacaccuccgagcacggcgggcgcgccuaccggcacgccguggaggagcugccggagaccauggagacccuccugcugcucggccugaugauccugcucaccggcggggccaugcuguuccugaucagcgggaaggggaucggcaagaccuccaucgggcucaucugcgugaucgccagcuccggcaugcuguggauggcggacgucccccugcaguggaucgccagcgccaucgugcucgaguucuucaugauggugcugcugauccccgagcccgagaagcagcgcaccccgcaggacaaccagcucgccuacgucgugaucgggauccugacccuggccgcgaucguggccgccaacgagaugggccuccuggagacgaccaagcgggaccugggcauguccaaggagcccggggucgugagccccaccuccuaccucgacguggaccugcaccccgccagcgccuggacccuguacgcggucgccacgaccgugaucaccccgaugcuccgccacaccaucgagaacuccacggccaacgugagccuggccgcgaucgccaaccaggccgucgugcugaugggccucgacaagggguggcccaucuccaagauggaccugggcgugccccugcucgcccuggggugcuacagccaggucaacccccugacccucaccgccgcggugcugcugcucgugacccacuacgccaucaucggcccgggccugcaggccaaggccacgcgggaggcccagaagcgcaccgcggccgggaucaugaagaaccccaccgucgacggcaucaugaccaucgaccuggaccccgugaucuacgacuccaaguucgagaagcagcucggccaggugaugcugcugguccucugcgccgugcagcugcugcucaugcggacgagcugggcccugugcgaggcccugacccucgcgaccggccccaucaccacgcugugggagggcuccccggggaaguucuggaacaccaccaucgccgugagcauggccaacaucuuccgcggcuccuaccuggccggggcgggccucgccuucagcaucaugaaguccgucgggaccggccggcgcggcacggggucccagggcgagacccugggggagaaguggaagaagaagcugaaccagcucagccggaaggaguucgaccuguacaagaaguccggcaucaccgagguggaccgcaccgaggccaaggaggggcugaagcggggcgagaccacgcaccacgccgugagccgcggcuccgccaagcuccagugguucgucgagcggaacauggugauccccgaggggcgcgugaucgaccugggcugcgggcgcggcggguggagcuacuacugcgcgggccugaagaaggucaccgaggugcggggcuacaccaagggcgggcccgggcacgaggagcccgugccgauguccaccuacggcuggaacaucgucaagcucaugagcgggaaggacguguucuaccugccgcccgagaagugcgacacgcugcugugcgacaucggcgaguccagccccuccccgaccguggaggagagccgcaccauccggguccucaagaugguggagcccuggcugcgcaacaaccaguucugcaucaaggugcugaaccccuacaugcccaccgucaucgagcaccucgagcggcugcagcgcaaguacggcgggaugcuggugcggaacccgcucucccgcaacagcacgcacgagauguacuggaucuccaacggcaccgggaacaucgugagcuccgucaacauggugagccggcugcugcucaaccgcuucaccaugacccaccggcgccccacgaucgagaaggacgucgaccugggcgccggcacccggcacgugaacgccgagcccgagaccccgaacauggacgugaucggggagcgcaucaagcggaucaaggaggagcacuccagcaccuggcacuacgacgacgagaaccccuacaagacgugggccuaccacggcagcuacgaggucaaggccaccggguccgcgagcuccaugaucaacggcguggugaagcugcucaccaagcccugggacgucgugcccauggugacccagauggccaugacggacaccaccccguucgggcagcagcgcgucuucaaggagaagguggacacccggacgccccgccccauggccggcacccggaaggugauggagaucaccgccgaguggcuguggcgcacccugggccgcaacaagaagccccggcucugcacgcgcgaggaguucaccaagaagguccggaccaacgccgcgaugggggccguguucaccgaggagaaccagugggacagcgcccgcgccgcgguggaggacgaggaguucuggaagcuggucgaccgggagcgcgagcugcacaagcucggcaagugcggguccugcguguacaacaugaugggcaagcgggagaagaagcugggggaguucggcaaggccaagggcagccgcgccaucugguacauguggcugggggcccgguaccucgaguucgaggcccugggcuuccugaacgaggaccacugguucucccgcgagaacagcuacuccgggguggagggcgaggggcuccacaagcugggcuacauccugcgggacaucagcaagaucccgggcggggcgauguacgccgacgacacggccggcugggacacccgcaucaccgaggacgaccuccacaacgaggagaagaucacccagcagauggaccccgagcaccggcagcuggccaacgccaucuucaagcugacguaccagaacaaggucgugaaggugcagcgccccacccccaaggggaccgucauggacaucaucucccggaaggaccagcgcggcagcggccagguggggaccuacggccucaacaccuucacgaacauggaggcgcagcuggugcggcagauggagggggagggcguccuguccaaggccgaccucgagaacccgcaccuccuggagaagaagaucacccaguggcucgagaccaaggggguggagcgccugaagcggauggccaucagcggcgacgacugcguggucaagcccaucgacgaccgcuucgccaacgcccugcucgcgcugaacgacaugggcaaggugcggaaggacaucccccaguggcagcccuccaagggguggcacgacuggcagcaggucccguucugcagccaccacuuccacgagcugaucaugaaggacggccgcaagcucgucgugcccugccgcccccaggacgagcugaucgggcgggcccgcaucucccagggcgccggguggagccugaaggagaccgccugccucggcaaggccuacgcgcagauguggucccugauguacuuccaccggcgcgaccugcggcucgccagcaacgccaucugcagcgccgugcccguccacuggaucccgacgucccgcaccaccuggagcauccacgcgcaccaccaguggaugaccacggaggacaugcugaccguguggaaccggguguggaucgaggacaaccccuggauggaggacaagacccccgucaccacgugggaggacgugcccuaccugggcaagcgcgaggaccaguggugcgggucccucaucggccugaccagccgggccaccugggcccagaacauccugaccgccauccagcagguccgcucccucaucggggacgaggaguuccuggacuacaugccgagcaugaagcgguuccgcaaggaggaggaguccgagggcgccaucugguga

SEQ ID NO: 9942 - RNA, 9873 nt, Artificial Sequence
  derived and/or modified CDS sequence (opt1) from DENV-3__GU131934__SS-prME
accagccugugccucaugaugaugcugcccgcgacccuggccuuccaccucaccagccgcgacggcgagccgcggaugaucguggggaagaacgagcgcggcaagagccugcuguucaagaccgcguccgggaucaacaugugcacccucaucgccauggaccugggcgagaugugcgacgacaccgucaccuacaagugcccccugaucgccgagguggagcccgaggacaucgacugcuggugcaaccucaccagcaccugggugaccuacgggaccugcaaccaggccggcgagcaccggcgcgacaagcgguccgucgcccuggcgccccacgugggcauggggcuggacacccgcacccagaccuggaugagcgccgagggcgccuggcggcaggucgagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggaucgacguggugcucgagcacggcgggugcgucaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacguggaccggggguggggcaacgggugcggccuguucgggaagggcagccuggugaccugcgccaaguuccagugccucgagcccaucgagggcaagguggugcaguacgagaaccugaaguacacggucaucaucaccgugcacaccggggaccagcaccaggugggcaacgacacccagggggucacgguggagaucacgccccaggccuccaccgucgaggccgugcugcccgaguacggcacccucgggcuggagugcagcccgcgcaccggccuggacuucaacgagaugauccuccugacgaugaagaacaaggcguggauggugcaccggcagugguucuucgaccugccccuccccuggaccuccggcgccaccaccgagacgcccaccuggaaccgcaaggagcugcuggucaccuucaagaacgcccacgccaagaagcaggagguggugguccucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggugagcgagacgcagcacgggaccauccugaucaaggucgaguacaagggcgaggacgccccgugcaagauccccuucagcaccgaggacgggcagggcaaggcgcacaacggccgccugaucaccgccaaccccguggugacgaagaaggaggagcccgucaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgugggcgggguccugaacucccucggcaagauggugcaccagaucuucgggagcgcguacaccgcccuguucuccggcgugagcuggaucaugaagaucggcaucgggguccugcucacguggaucggccugaacuccaagaacaccagcauguccuucagcugcaucgugaucggggugaucacccuguaccucggcgccgucgugcaggccgacauggggugcgugaucaacuggaagggcaaggagcugaagugcggcaacgggaucuucgucaccaacgaggugcacacguggaccgagcaguacaaguuccaggccgacucccccaagcgccuggcgaccgccaucgccggcgccugggagaacggggugugcggcauccgcagcaccacgcggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacuccuggaagacgugggggaaggcgaagaucgugaccgccgagaaccagaacagcuccuucaucaucgacggccccaacacccccgagugccccagcgccucccgggccuggaacgugugggaggucgaggacuacggguucggcguguucaccacgaacaucuggcugaagcuccgcgagguguacacccagagcugcgaccaccggcugaugagcgcggccaucaaggacgagcgcgccguccacgccgacaugggcuacuggaucgagucccagaagaacgggagcuggaagcuggagaaggccuccuucaucgaggugaagaccugcaccuggcccaagagccacacccucugguccaacggcgugcuggagagcgacaugaucauccccaagucccuggcggggcccaucagccagcacaaccaccggccgggcuaccacacgcagaccgccgggcccuggcaccucggcaagcuggagcuggacuucaacuacugcgagggcaccaccgucgugaucgccgagaacugcgggacgcgcggccccucccuccggaccaccaccgugagcgggaagcugauccacgaguggugcugccgcuccugcacgcugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgcgggggugcuguucaccuucguccuccugcuguccggccagaucaccuggcgcgacauggcccacacgcucaucaugaucggcagcaacgccuccgaccggauggggaugggcgugaccuaccuggcccugaucgccaccuucaagauccagcccuuccucgcgcugggguucuuccugcgcaagcucaccagccgggagaaccugcugcucggcgugggccuggccauggccacgacccugcagcuccccgaggacaucgagcagauggccaacgggaucgcgcugggccugaugacccucaagcugaucacccaguucgagacguaccagcuguggaccgcccucgucagccugaccugcuccaacaccaucuucacgcugaccguggccuggcgcaccgccacccucauccuggccggggucagccugcucccgcugugccaguccagcuccaugcggaagacggacuggcugcccaugaccguggcggccaugggcgugccgccccugccgcuguucaucuucagccugaaggacacccccaagcgccgcuccuggccccucaacgagggggucauggccgugggccuggugagcauccuggccuccagccuccugcggaacgacguccccauggccggcccgcugguggccggcgggcuccugaucgccugcuacgugaucaccgggacguccgccgaccugaccgucgagaaggccgccgacgugaccugggaggaggaggcggagcagaccggggugagccacaaccucaugaucacggucgacgacgacgggaccaugcgcaucaaggacgacgagaccgagaacauccugaccgugcugcucaagaccgcccugcugaucguguccggcaucuuccccuacagcauccccgccacgcuccuggucuggcacaccuggcagaagcagacccagcgguccggcgugcugugggacgugcccagcccgcccgagacccagaaggccgagcucgaggagggggucuaccgcaucaagcagcagggcaucuucgggaagacccaggugggcguggggguccagaaggagggcguguuccacaccauguggcacgugacccggggcgccguccugacccacaacgggaagcgccuggagcccaacugggcguccgugaagaaggaccucaucagcuacggcgggggcuggcggcuguccgcccaguggcagaagggggaggaggugcaggucaucgccguggagcccggcaagaacccgaagaacuuccagacgauccccggcaucuuccagaccaccaccggggagaucggcgccaucgcgcuggacuucaagcccgggacgagcggcagcccgaucaucaaccgcgagggcaagguggucgggcuguacggcaacgggguggugaccaagaacggcggguacgucuccggcaucgcccagaccaacgccgagcccgacggccccacccccgagcucgaggaggagauguucaagaagcggaaccugacgaucauggaccugcacccggggagcggcaagacccgcaaguaccuccccgccaucgugcgggaggccaucaagcgccggcugcgcacccugauccucgcgcccacccggguggucgccgccgagauggaggaggcccugaaggggcugcccauccgcuaccagacgaccgccaccaaguccgagcacaccggccgggagaucguggaccucaugugccacgcgacguucaccaugcgccugcugagcccggugcggguccccaacuacaaccucgugaucauggacgaggcccacuucaccgaccccgccuccaucgccgcccgcggguacaucagcacccgggugggcaugggcgaggcggccgccaucuucaugacggccacgccgcccgggaccgcggaggccuucccccaguccaacgcccccauccaggacgaggagcgcgacauccccgagcgcagcuggaacuccggcaacgaguggaucaccgacuucgucgggaagacggugugguucgugcccagcaucaaggccggcaacgacaucgccaacugccugcggaagaacgggaagaaggucauccagcugucccgcaagaccuucgacaccgaguaccagaagacccggcucaacgacugggacuucguggugacgaccgacaucagcgagaugggcgcgaacuucaaggccgaccgcgucaucgacccccggcgcugccugaagcccgugauccugaccgacggccccgagcgggugauccucgccgggccgaugcccgucaccgccgccuccgcggcccagcgccggggccgcguggggcggaacccccagaaggagaacgaccaguacaucuucacgggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucgucgagcucaugcggcgcggggaccugcccguguggcuggcccacaagguggccagcgagggcaucaaguacaccgaccggaaguggugcuucgacggggagcgcaacaaccagauccucgaggagaacauggacgucgagaucuggacgaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcgggugcccucccaccuggcgcaccgcacccggaacgcccuggacaaccucgucaugcugcacacgagcgagcacggcgggcgcgccuaccggcacgccguggaggagcugccggagaccauggagacccuccugcugcucggccugaugauccugcucaccgggggcgccaugcuguuccugaucagcggcaaggggaucggcaagacguccaucgggcucaucugcgugaucgucagcuccggcaugcuguggauggcggacgugccccugcaguggaucgccagcgccaucgugcucgaguucuucaugaugguccugcugauccccgagcccgagaagcagcgcaccccgcaggacaaccagcucgccuacguggugaucgggauccugacccuggccgcgaucgucgccgccaacgagaugggccuccuggagaccacgaagcgggaccugggcauguccaaggagcccgggguggugagccccaccuccuaccucgacgucgaccugcaccccgccagcgccuggacccuguacgcgguggccaccacggugaucaccccgaugcuccgccacaccaucgagaacuccaccgccaacgucagccuggccgcgaucgccaaccaggccguggugcugaugggccucgacaagggguggcccaucuccaagauggaccugggcgucccccugcucgcccuggggugcuacagccaggugaacccccugacgcucaccgccgcggugcugcugcucgucacccacuacgccaucaucggcccgggccugcaggccaaggccacccgggaggcccagaagcgcacggcggccgggaucaugaagaaccccaccguggacggcaucaugaccaucgaccuggaccccgugaucuacgacuccaaguucgagaagcagcucgggcaggucaugcugcuggugcucugcgccgugcagcugcugcucaugcggaccagcugggcccugugcgaggcccugacgcucgcgaccggccccaucaccacccugugggagggcuccccggggaaguucuggaacacgaccaucgccgucagcauggccaacaucuuccgcggcuccuaccuggccggggcgggccucgccuucagcaucaugaaguccguggggaccggccggcgcggcaccgggagccagggcgagacgcugggggagaaguggaagaagaagcugaaccagcucagccggaaggaguucgaccuguacaagaaguccggcaucaccgagguggaccgcaccgaggccaaggaggggcugaagcggggcgagaccacccaccacgccgucagccgcggcuccgccaagcuccagugguucguggagcggaacauggugauccccgaggggcgcgucaucgaccugggcugcgggcgcggcggguggagcuacuacugcgcgggccugaagaaggugacggaggugcggggcuacaccaagggcggccccgggcacgaggagcccgucccgauguccaccuacggcuggaacaucgugaagcucaugagcgggaaggacguguucuaccugccgcccgagaagugcgacacccugcugugcgacaucggcgaguccagccccuccccgacggucgaggagagccgcaccauccgggugcucaagaugguggagcccuggcugcgcaacaaccaguucugcaucaagguccugaaccccuacaugcccaccgugaucgagcaccucgagcggcugcagcgcaaguacggcgggaugcuggugcggaacccgcucucccgcaacagcacccacgagauguacuggaucuccaacggcacggggaacaucgucagcuccgugaacauggucagccggcugcugcucaaccgcuucaccaugacccaccggcgccccaccaucgagaaggacguggaccugggcgccggcacgcggcacgugaacgccgagcccgagaccccgaacauggacgucaucggggagcgcaucaagcggaucaaggaggagcacuccagcaccuggcacuacgacgacgagaaccccuacaagaccugggccuaccacggcuccuacgaggugaaggccacggggagcgcgagcuccaugaucaacggcguggucaagcugcucaccaagcccugggacguggugcccauggucacccagauggccaugaccgacacgaccccguucgggcagcagcgcguguucaaggagaagguggacacccggacgccccgccccaugcccggcacgcggaaggucauggagaucaccgccgaguggcuguggcgcacccugggccgcaacaagaagccgcggcucugcacccgcgaggaguucacgaagaaggugcggaccaacgccgccaugggggcgguguucaccgaggagaaccagugggacagcgcccgcgccgccgucgaggacgaggaguucuggaagcugguggacaaggagcgggagcugcacaagcucggcaagugcggguccugcguguacaacaugaugggcaagcgcgagaagaagcugggggaguucggcaaggcgaagggcagccgggccaucugguacauguggcugggggcccgcuaccucgaguucgaggcccugggcuuccugaacgaggaccacugguucucccgggagaacagcuacuccggggucgagggcgaggggcuccacaagcugggcuacauccugcgcgacaucagcaagauccccggcggggccauguacgcggacgacaccgccggcugggacacgcggaucaccgaggacgaccuccacaacgaggagaagaucacccagcagauggaccccgagcaccgccagcuggccaacgccaucuucaagcugaccuaccagaacaagguggugaagguccagcggcccacgccgaaggggaccgugauggacaucaucucccgcaaggaccagcggggcagcggccagguggggaccuacggccucaacaccuucaccaacauggaggcccagcugguccgccagauggagggggagggcgugcuguccaaggcggaccucgagaacccccaccuccuggagaagaagaucacgcaguggcucgagaccaaggggguggagcggcugaagcgcauggccaucagcggcgacgacugcgucgugaagcccaucgacgaccgguucgccaacgcccugcucgcccugaacgacaugggcaaggugcgcaaggacaucccccaguggcagccguccaagggguggcacgacuggcagcagguccccuucugcagccaccacuuccacgagcugaucaugaaggacggccggaagcucguggugcccugccgcccccaggacgagcugaucgggcgcgcgcggaucucccagggcgccggguggagccugaaggagaccgccugccucggcaaggccuacgcccagauguggucccugauguacuuccaccgccgggaccugcgccucgcgagcaacgccaucugcuccgccgucccggugcacuggauccccaccagccggacgaccuggagcauccacgcccaccaccaguggaugaccaccgaggacaugcugacgguguggaaccgcgucuggaucgaggacaaccccuggauggaggacaagacccccgugaccaccugggaggacgugccguaccugggcaagcgggaggaccaguggugcgggucccucaucggccugacgagccgcgcgaccugggcccagaacauccugaccgccauccagcagguccggucccucaucggggacgaggaguuccuggacuacaugcccagcaugaagcgcuuccggaaggaggaggagaccgagggcgccaucugguga

SEQ ID NO: 9943 - RNA, 9873 nt, Artificial Sequence
  derived and/or modified CDS sequence (opt1) from DENV-3__GU131935__SS-prME
accagccugugccucaugaugaugcugcccgcgacccuggccuuccaccucaccagccgcgacggcgagccccggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccgucgcccuggcgccccacgugggcauggggcuggacacccgcacccagaccuggaugagcgccgagggcgccuggcgccagguggagaaggucgagaccugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgccaucaacuggaagggcaaggagcugaagugcggcuccgggaucuucgugaccaacgagguccacacguggaccgagcaguacaaguuccaggcggacagccccaagcgccuggccaccgccaucgccggcgccugggagaacggggugugcggcauccgcuccaccacgcggauggagaaccuccuguggaagcagaucgcgaacgagcugaacuacauccucugggagaacaacaucaagcugaccguggucgugggggacaucaucggcgugcuggagcagggcaagcgcacccucacgccccagccgauggagcugaaguacagcuggaagacgugggggaaggccaagaucgucaccgccgagacccagaacuccagcuucaucaucgacggccccaacacccccgagugccccuccgccagccgggcguggaacgugugggagguggaggacuacggguucggcgucuucacgaccaacaucuggcugaagcuccgcgagguguacacccagagcugcgaccaccggcugauguccgccgccaucaaggacgagcgcgccgugcacgccgacaugggcuacuggaucgagagccagaagaacggguccuggaagcuggagaaggcgagcuucaucgaggucaagaccugcaccuggccgaagucccacacgcucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcaccacgguggucaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucaacgagaaggaggagaacauggugaagucccuggucagcgccggcuccgggaagguggacaacuucaccaugggcgugcugugccucgccauccuguucgaggaggucaugcgggggaaguucggcaagaagcacaugaucgcgggggugcuguucacguucgugcuccugcugagcggccagaucaccuggcgcgacauggcccacacccucaucaugaucggcuccaacgccagcgaccggauggggaugggcgucaccuaccuggcccugaucgccacguucaagauccagcccuuccucgcgcugggguucuuccugcgcaagcucaccagccgggagaaccugcugcucggcgugggccuggccauggccaccacccugcagcuccccgaggacaucgagcagauggccaacgggaucgcgcugggccugaugacgcucaagcugaucacccaguucgagaccuaccagcuguggaccgcccucgugucccugacgugcagcaacaccaucuucacccugaccgucgccuggcgcacggccacccucauccuggccggggugucccugcucccgcugugccagagcuccagcaugcggaagaccgacuggcugcccaugaccgucgcggccaugggcgugccgccccugccgcuguucaucuucucccugaaggacacgcccaagcgccgcagcuggccccucaacgagggggugauggccgucggccugguguccauccuggccagcucccuccugcggaacgacgugcccauggccggcccgcuggucgccggcgggcuccugaucgccugcuacgugaucaccgggaccagcgccgaccugaccguggagaaggccgccgacgucacgugggaggaggaggcggagcagaccggggugucccacaaccucaugaucaccguggacgacgacgggaccaugcgcaucaaggacgacgagaccgagaacauccugacgguccugcucaagaccgcccugcugaucgugagcggcaucuuccccuacuccauccccgccacccuccugguguggcacaccuggcagaagcagacgcagcggagcggcguccugugggacgugcccuccccgcccgagacccagaaggccgagcucgaggaggggguguaccgcaucaagcagcagggcaucuucgggaagacccaggucggcgugggggugcagaaggagggcgucuuccacaccauguggcacgugacgcggggcgccgugcugacccacaacgggaagcgccuggagcccaacugggcgagcgucaagaaggaccucaucuccuacggcgggggcuggcggcugaacgcccaguggcagaagggggaggagguccaggugaucgccgucgagcccggcaagaacccgaagaacuuccagaccaugcccggcaucuuccagaccacgaccggggagaucggcgccaucgcgcuggacuucaagcccgggaccagcggcagcccgaucaucaaccgcgagggcaaggugguggggcuguacggcaacggggucgugaccaagaacggcggguacguguccggcaucgcccagacgaacgccgagcccgacggccccacccccgagcucgaggaggagauguucaagaagcggaaccugaccaucauggaccugcacccggggagcggcaagacccgcaaguaccuccccgccaucguccgggaggccaucaagcgccggcugcgcacgcugauccucgcgcccacccgggugguggccgccgagauggaggaggcccugaaggggcugcccauccgcuaccagaccaccgccacgaaguccgagcacaccggccgggagaucgucgaccucaugugccacgcgaccuucaccaugcgccugcugagcccggugcgggugcccaacuacaaccucgucaucauggacgaggcccacuucacggaccccgccuccaucgccgcccgcggguacaucagcacccgggugggcaugggcgaggcggccgccaucuucaugaccgccacgccgcccgggacggcggaggccuucccccaguccaacgcccccauccaggacgaggagcgcgacauccccgagcgcagcuggaacuccggcaacgaguggaucaccgacuucguggggaagaccgucugguucgugcccagcaucaaggccggcaacgacaucgccaacugccugcggaagaacgggaagaaggugauccagcugucccgcaagaccuucgacacggaguaccagaagacccggcucaacgacugggacuucgucgugaccaccgacaucagcgagaugggcgcgaacuucaaggccgaccgcgugaucgacccccggcgcugccugaagcccgucauccugacggacggccccgagcgggugauccucgccgggccgaugcccgugaccgccgccuccgcggcccagcgccggggccgcgucgggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagacguucguggagcucaugcggcgcggggaccugcccgucuggcuggcccacaagguggccagcgagggcaucaaguacaccgaccggaaguggugcuucgacggggagcgcaacaaccagauccucgaggagaacauggacguggagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgucacggagaucgggcgggugcccucccaccuggcgcaccgcacccggaacgcccuggacaaccucgugaugcugcacaccagcgagcacggcgggcgcgccuaccggcacgccgucgaggagcugccggagaccauggagacgcuccugcugcucggccugaugauccugcucaccgggggcgugaugcuguuccugaucagcggcaaggggaucggcaagaccuccaucgggcucaucugcgugaucgucagcuccggcaugcuguggauggccgacgugccccugcaguggaucgcgagcgccaucgugcucgaguucuucaugaugguccugcugauccccgagcccgagaagcagcgcaccccgcaggacaaccagcucgccuacguggugaucgggauccugacgcuggccgccaucgucgcggccaacgagaugggccuccuggagaccaccaagcgggaccugggcauguccaaggagcccgggguggugagccccaccuccuaccucgacgucgaccugcaccccgccagcgccuggacgcuguacgccguggcgaccaccgugaucaccccgaugcuccgccacacgaucgagaacuccaccgccaacgucagccuggccgccaucgcgaaccaggccguggugcugaugggccucgacaagggguggcccaucuccaagauggaccugggcgucccccugcucgcccuggggugcuacagccaggugaacccccugacccucaccgccgccgugcugcugcucgucacgcacuacgcgaucaucggcccgggccugcaggccaaggccacccgggaggcccagaagcgcaccgccgcggggaucaugaagaaccccaccguggacggcaucaugacgaucgaccuggaccccgugaucuacgacuccaaguucgagaagcagcucgggcaggucaugcugcuggugcucugcaccgugcagcugcugcucaugcggaccagcugggcccugugcgaggcccugacccucgccacgggccccaucaccacccugugggagggcuccccggggaaguucuggaacaccacgaucgccgucagcauggcgaacaucuuccgcggcuccuaccuggccggggccggccucgccuucagcaucaugaaguccguggggaccggccggcgcggcaccgggagccagggcgagacccugggggagaaguggaagaagaagcugaaccagcucagccggaaggaguucgaccuguacaagaaguccggcaucaccgagguggaccgcacggaggcgaaggaggggcugaagcggggcgagaccacccaccacgccgucagccgcggcuccgccaagcuccagugguucguggagcggaacauggugauccccgaggggcgcgucaucgaccugggcugcgggcgcggcggguggagcuacuacugcgccggccugaagaaggugaccgaggugcggggcuacacgaagggcggccccgggcacgaggagcccgucccgauguccaccuacggcuggaacaucgugaagcucaugagcgggaaggacguguucuaccugccgcccgagaagugcgacacccugcugugcgacaucggcgaguccagccccuccccgaccgucgaggagagccgcacgauccgggugcucaagaugguggagcccuggcugcgcaacaaccaguucugcaucaagguccugaaccccuacaugcccaccgugaucgagcaccucgagcggcugcagcgcaaguacggcgggaugcuggugcggaacccgcucucccgcaacagcacccacgagauguacuggaucuccaacggcaccgggaacaucgucagcuccgugaacauggucagccggcugcugcucaaccgcuucacgaugacccaccggcgccccaccaucgagaaggacguggaccugggcgccggcacccggcacgugaacgcggagcccgagacgccgaacauggacgucaucggggagcgcaucaagcggaucaaggaggagcacuccagcaccuggcacuacgacgacgagaaccccuacaagaccugggccuaccacggcuccuacgaggugaaggccaccgggagcgccagcuccaugaucaacggcguggucaagcugcucacgaagcccugggacguggugcccauggucacccagauggccaugaccgacaccacgccguucgggcagcagcgcguguucaaggagaagguggacacccggacgccccggcccaugcccggcacccggaaggucauggagaucacggcggaguggcuguggcgcacccugggccgcaacaagaagccgcggcucugcacccgcgaggaguucaccaagaaggugcggacgaacgccgccaugggggccguguucaccgaggagaaccagugggacagcgcccgcgcggccgucgaggacgaggaguucuggaagcugguggaccgggagcgcgagcugcacaagcucggcaagugcggguccugcguguacaacaugaugggcaagcgggagaagaagcugggggaguucggcaaggccaagggcagccgcgccaucugguacauguggcugggggcgcgguaccucgaguucgaggcccugggcuuccugaacgaggaccacugguucucccgcgagaacagcuacuccggggucgagggcgaggggcuccacaagcugggcuacauccugcgggacaucagcaagauccccggcggggccauguacgccgacgacaccgccggcugggacacccgcaucacggaggacgaccuccacaacgaggagaagaucacccagcagauggaccccgagcaccggcagcuggcgaacgccaucuucaagcugaccuaccagaacaagguggugaagguccagcgccccaccccgaaggggaccgugauggacaucaucucccggaaggaccagcgcggcagcggccagguggggacguacggccucaacaccuucaccaacauggaggcccagcugguccggcagauggagggggagggcgugcuguccaaggccgaccucgagaacccccaccuccuggagaagaagaucacccaguggcucgagacgaaggggguggagcgccugaagcggauggccaucagcggcgacgacugcgucgugaagcccaucgacgaccgcuucgcgaacgcccugcucgcccugaacgacaugggcaaggugcggaaggacaucccccaguggcagccguccaagggguggcacgacuggcagcagguccccuucugcagccaccacuuccacgagcugaucaugaaggacggccgcaagcucguggugcccugccgcccccaggacgagcugaucgggcgggcccgcaucucccagggcgccggguggagccugaaggagaccgcgugccucggcaaggccuacgcccagauguggucccugauguacuuccaccggcgcgaccugcggcucgccagcaacgccaucugcuccgcggucccggugcacuggauccccaccagccgcaccacguggagcauccacgcccaccaccaguggaugaccaccgaggacaugcugaccguguggaaccgggucuggaucgaggacaaccccuggauggaggacaagacgcccgugaccaccugggaggacgugccguaccugggcaagcgcgaggaccaguggugcgggucccucaucggccugaccagccgggccacgugggcccagaacauccugaccgcgauccagcagguccgcucccucaucgggaacgaggaguuccuggacuacaugcccagcaugaagcgguuccgcaaggaggaggaguccgagggcgccaucugguga

SEQ ID NO: 9944 - RNA, 9873 nt, Artificial Sequence
  derived and/or modified CDS sequence (opt1) from DENV-3__GU131936__SS-prME
accagccugugccucaugaugaugcugcccgccacccuggccuuccaccucaccagccgggacggcgagccccggaugaucguggggaagaacgagcgcggcaagagccugcuguucaagaccgcguccgggaucaacaugugcacccucaucgccauggaccugggcgagaugugcgacgacaccgucacguacaagugcccccugaucgccgagguggagcccgaggacaucgacugcuggugcaaccucaccagcaccugggugaccuacgggaccugcaaccaggccggcgagcaccggcgcgacaagcgguccgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgaguccaucgagggcaaggugguccaguacgagaaccugaaguacacggugaucaucaccgugcacaccggggaccagcaccaggucggcaacgacacccagggggugacggucgagaucacgccccaggccagcaccguggaggccgugcugcccgaguacggcacccucgggcuggagugcagcccccggaccggccuggacuucaacgagaugauccuccugacgaugaagaacaaggcguggaugguccaccggcagugguucuucgaccugccgcuccccuggaccagcggcgccaccaccgagacgcccaccuggaaccgcaaggagcugcuggugaccuucaagaacgcccacgccaagaagcaggagguggucgugcucgggucccaggagggcgccaugcacaccgcgcugacgggggccaccgagauccagaacagcggcgggaccuccaucuucgccggccaccugaagugccggcucaagauggacaagcuggagcugaagggcaugagcuacgccaugugccucaacaccuucgugcugaagaaggaggucagcgagacgcagcacgggaccauccugaucaagguggaguacaagggcgaggacgcccccugcaagaucccguucuccaccgaggacgggcagggcaaggcgcacaacggccgccugaucaccgccaaccccguggucacgaagaaggaggagcccgugaacaucgaggccgagcccccguucggggagagcaacaucgugaucggcaucggggacaaggcccucaagaucaacugguacaagaagggcuccagcaucgggaagauguucgaggcgaccgcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucacguggaucggccugaacagcaagaacaccuccaugagcuucuccugcaucgugaucgggaucaucacccuguaccucggcgccgucgugcaggccgacauggggugcgugaucaacuggaagggcaaggagcugaagugcggcaacgggaucuucgucaccaacgaggugcacacguggaccgagcaguacaaguuccaggccgacagccccaagcgccuggcgaccgccaucgccggcgccugggagaacggggugugcggcauccgcuccaccacgcggauggagaaccuccuguggaagcagaucgccaacgagcugaacuacauccucugggagaacaacaucaagcugaccgucguggugggggacaucaucggcguccuggagcagggcaagcgcgcgcucacgccccagcccauggagcugaaguacagcuggaagaccugggggaaggccaagaucgugacggccgagacccagaacuccagcuucaucaucgacggcccgaacacccccgagugccccuccgccagccgggcguggaacgugugggaggucgaggacuacggguucggcguguucaccacgaacaucuggcugaagcuccgcgagguguacacccagagcugcgaccaccggcugauguccgccgccaucaaggacgagcgcgccguccacgccgacaugggcuacuggaucgagagccagaagaacggguccuggaagcuggagaaggcgagcuucaucgaggugaagaccugcaccuggcccaagucccacacccucuggagcaacggcgugcuggaguccgacaugaucauccccaagucccuggccgggcccaucucccagcacaaccaccggcccggcuaccacacgcagaccgccgggccguggcaccucggcaagcuggagcuggacuucaacuacugcgagggcaccaccgucgugaucgccgagaacugcgggacgcgcggccccagccuccggaccaccaccguguccgggaagcugauccacgaguggugcugccgcagcugcacgcugccgccccugcgguacaugggcgaggacgggugcugguacggcauggagauccgcccgaucaacgagaaggaggagaacauggucaagucccuggugagcgccggcuccgggaagguggacaacuucaccaugggcguccugugccucgcgauccuguucgaggaggugaugcgggggaaguucggcaagaagcacaugaucgccggggugcuguucaccuucguccuccugcugagcggccagaucaccuggcgcgacauggcccacacgcucaucaugaucggcuccaacgccagcgaccggauggggaugggcgugaccuaccuggcccugaucgcgaccuucaagauccagcccuuccucgcccugggguucuuccugcgcaagcucaccagccgggagaaccugcugcucggcgugggccuggccauggccacgacccugcagcuccccgaggacaucgagcagauggcgaacgggaucgcccugggccugaugacccucaagcugaucacccaguucgagacguaccagcuguggaccgcccucgucucccugaccugcagcaacaccaucuucacgcugaccguggccuggcgcaccgccacccucauccuggcgggggucucccugcucccccugugccagagcuccagcaugcggaagacggacuggcugccgaugaccguggccgccaugggcgugccgccccucccccuguucaucuucucccugaaggacaccccgaagcgccgcagcuggccccucaacgagggggucauggccgugggccugguguccauccuggccagcucccuccugcggaacgacguccccauggcgggcccccugguggccgggggccuccugaucgccugcuacgugaucaccgggacgagcgccgaccugaccgucgagaaggccgcggacgugaccugggaggaggaggccgagcagaccggcgugucccacaaccucaugaucacggucgacgacgacgggaccaugaagaucaaggacgacgagaccgagaacauccugaccgugcugcucaagaccgcccugcugaucgugagcggcaucuucccguacuccauccccgccacgcuccuggucuggcacaccuggcagaagcagacccagcgcagcggcgugcugugggacgugcccagcccgcccgagacccagaaggccgagcucgaggagggggucuaccggaucaagcagcagggcaucuucgggaagacccaggugggcguggggguccagaaggagggcguguuccacaccauguggcacgugacccgcggcgcgguccugacccacaacgggaagcggcuggagcccaacugggccagcgugaagaaggaccucaucuccuacggcgggggcuggcgccugagcgcccaguggcagaagggggaggaggugcaggucaucgccguggagcccggcaagaaccccaagaacuuccagacgaugcccggcaucuuccagaccaccaccggggagaucggcgcgaucgcccuggacuucaagcccgggacgagcggcucccccaucaucaaccgggagggcaagguggucgggcuguacggcaacgggguggugaccaagaacggcggguacgucagcggcaucgcccagaccaacgccgagccggacggccccacccccgagcucgaggaggagauguucaagaagcgcaaccugacgaucauggaccugcaccccggguccggcaagacccggaaguaccucccggccaucgugcgcgaggcgaucaagcggcgccugcggacccugauccucgcccccacccgcguggucgccgccgagauggaggaggcccugaaggggcugcccauccgguaccagacgaccgcgaccaagagcgagcacaccggccgcgagaucguggaccucaugugccacgccacguucaccaugcggcugcugucccccgugcgcgucccgaacuacaaccucgugaucauggacgaggcccacuucaccgaccccgccagcaucgccgcgcggggguacaucuccacccgcgugggcaugggcgaggccgccgccaucuucaugacggcgacgccgcccgggaccgccgaggccuucccgcagagcaacgcccccauccaggacgaggagcgggacauccccgagcgcuccuggaacagcggcaacgaguggaucaccgacuucgucgggaagacggugugguucgugcccuccaucaaggccggcaacgacaucgcgaacugccugcgcaagaacgggaagaaggucauccagcugagccggaagaccuucgacaccgaguaccagaagacccgccucaacgacugggacuucguggugacgaccgacaucuccgagaugggcgccaacuucaaggccgaccgggucaucgacccgcgccggugccugaagcccgugauccugaccgacggccccgagcgcgugauccucgccgggcccaugccggucaccgccgcgagcgccgcccagcggcgcggccggguggggcgcaacccccagaaggagaacgaccaguacaucuucaugggccagccccugaacaacgacgaggaccacgcccacuggacggaggccaagaugcugcucgacaacaucaacacccccgaggggaucaucccggcgcuguucgagcccgagcgggagaaguccgccgccaucgacggcgaguaccgccugaagggcgagagccggaagaccuucgucgagcucaugcgccgcggggaccugcccguguggcuggcccacaagguggcguccgagggcaucaaguacaccgaccgcaaguggugcuucgacggggagcggaacaaccagauccucgaggagaacauggacgucgagaucuggaccaaggagggcgagcgcaagaagcugcggccccgcuggcuggacgcccgcacguacagcgacccgcucgcccugaaggaguucaaggacuucgccgccggccggaaguccaucgcgcuggaccucgugaccgagaucgggcgcgugcccagccaccuggcccaccggacccgcaacgcccuggacaaccucgucaugcugcacaccagcgagcacggcgggcgggccuaccgccacgccguggaggagcugcccgagacgauggagacccuccugcugcucggccugaugauccugcucaccgggggcgcgaugcuguuccugaucuccggcaaggggaucggcaagaccagcaucgggcucaucugcgugaucgucuccagcggcaugcuguggauggccgacgugccgcugcaguggaucgccuccgccaucgugcucgaguucuucaugaugguccugcugauccccgagcccgagaagcagcggacgccccaggacaaccagcucgccuacguggugaucgggauccugacccuggcggccaucgucgccgccaacgagaugggccuccuggagaccaccaagcgcgaccugggcaugagcaaggagccggggguggugucccccacgagcuaccucgacgucgaccugcaccccgccuccgcguggacccuguacgccguggccaccaccgugaucacgcccaugcuccggcacaccaucgagaacagcaccgccaacgucucccuggcggccaucgccaaccaggccguggugcugaugggccucgacaagggguggccgaucagcaagauggaccugggcgucccccugcucgcccuggggugcuacucccaggugaacccccugacccucacggcggccgugcugcugcucgucacccacuacgccaucaucggccccggccugcaggccaaggccacccgcgaggcgcagaagcggaccgccgccgggaucaugaagaacccgacgguggacggcaucaugaccaucgaccuggaccccgugaucuacgacagcaaguucgagaagcagcucgggcaggucaugcugcuggugcucugcgccgugcagcugcugcucaugcgcaccuccugggcccugugcgaggcgcugacccucgccacgggccccaucaccacccugugggagggcagccccgggaaguucuggaacaccacgaucgccgucuccauggccaacaucuuccggggcagcuaccuggcgggggccggccucgccuucuccaucaugaaguccguggggaccggccgccggggcaccgggagccagggcgagacccugggggagaaguggaagaagaagcugaaccagcucucccgcaaggaguucgaccuguacaagaaguccggcaucacggagguggaccggaccgaggccaaggaggggcugaagcgcggcgagaccacccaccacgccgucucccggggcagcgcgaagcuccagugguucguggagcgcaacauggugaucccggaggggcgggucaucgaccugggcugcgggcgcggcgggugguccuacuacugcgccggccugaagaaggugaccgaggugcgcggcuacacgaagggcgggcccgggcacgaggagcccguccccaugagcaccuacggcuggaacaucgugaagcucauguccgggaaggacguguucuaccugccgcccgagaagugcgacacccugcugugcgacaucggcgagagcucccccagccccaccgucgaggagucccggacgauccgcgugcucaagaugguggagccguggcugcggagcaaccaguucugcaucaagguccugaaccccuacaugcccaccgugaucgagcaccucgagcgccugcagcggaaguacggcgggaugcuggugcgcaacccccucucccggaacagcacccacgagauguacuggaucuccaacggcaccgggaacaucgucagcuccgugaacauggucagccgccugcugcucaaccgguucacgaugacccaccgccggccgaccaucgagaaggacguggaccugggcgccggcacccgccacgugaacgccgagcccgagacgcccaacauggacgucaucggggagcggaucaagcgcaucaaggaggagcacuccagcaccuggcacuacgacgacgagaacccguacaagaccugggccuaccacggcagcuacgaggugaaggcgaccggguccgccagcuccaugaucaacggcguggucaagcugcucacgaagcccugggacguggugcccauggucacccagauggccaugaccgacaccacgcccuucgggcagcagcggguguucaaggagaagguggacacccgcaccccgcggcccaugcccggcacccgcaaggucauggagaucacggccgaguggcuguggcggacccugggccgcaacaagaagccccgccucugcacccgggaggaguucaccaagaaggugcgcacgaacgccgcgaugggggccguguucaccgaggagaaccagugggacagcgcccgggccgcggucgaggacgaggaguucuggaagcugguggacaaggagcgcgagcugcacaagcucggcaagugcggguccugcguguacaacaugaugggcaagcgggagaagaagcugggggaguucggcaaggccaagggcagccgcgccaucugguacauguggcugggggcccgguaccucgaguucgaggcccugggcuuccugaacgaggaccacugguucucccgcgagaacagcuacuccggggucgagggcgaggggcuccacaagcugggcuacauccugcgggacaucagcaagaucccgggcggggcgauguacgccgacgacaccgccggcugggacacccgcaucacggaggacgaccuccacaacgaggagaagaucacccagcagauggaccccgagcaccggcagcuggccaacgccaucuucaagcugaccuaccagaacaagguggugaagguccagcgccccacccccaaggggacggugauggacaucaucucccggaaggaccagcgcggcagcggccagguggggaccuacggccucaacaccuucaccaacauggaggcgcagcugguccggcagauggagggggagggcgugcuguccaaggccgaccucgagaacccgcaccuccuggagaagaagaucacccaguggcucgagacgaaggggguggagcgccugaagcggauggccaucagcggcgacgacugcgucgugaagcccaucgacgaccgcuucgccaacgcccugcucgcgcugaacgacaugggcaaggugcggaaggacaucccccaguggcagcccuccaagggguggcacgacuggcagcaggucccguucugcagccaccacuuccacgagcugaucaugaaggacggccgcaagcucguggugcccugccggccccaggacgagcugaucgggcgcgcccgcaucucccagggcgccggguggagccugaaggagaccgccugccucggcaaggccuacgcgcagauguggucccugauguacuuccaccggcgcgaccugcggcucgccagcaacgccaucugcagcgccguccccgugcacuggaucccgaccucccgcaccacguggagcauccacgcgcaccaccaguggaugaccaccgaggacaugcugaccguguggaaccgggucuggaucgaggacaaccccuggauggaggacaagacgcccgugaccaccugggaggacgugcccuaccugggcaagcgcgaggaccaguggugcgggucccucaucggccugaccagccgggccacgugggcccagaacauccugaccgccauccagcagguccgcucccucaucggggacgaggaguuccuggacuacaugccgagcaugaagcgguuccgcaaggaggaggagaccgagggcgccaucugguga

SEQ ID NO: 9945 - RNA, 9873 nt, Artificial Sequence
  derived and/or modified CDS sequence (opt1) from DENV-3__GU131937__SS-prME
accagccugugccucaugaugaugcugcccgccacccuggccuuccaccucaccagccgcgacggcgagccgcggaugaucguggggaagaacgagcgcggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcggagcgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacacguggaccgagcaguacaaguuccaggccgacagccccaagcgccuggcgaccgccaucgccggcgccugggagaacggggugugcggcauccgcuccaccacgcggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacagcuggaagacgugggggaaggcgaagaucgugaccgccgagacccagaacuccagcuucaucaucgacggccccaacacccccgagugccccuccacgcugcgggccuggaacgugugggaggucgaggacuacggguucggcguguucaccaccaacaucuggcucaagcugcgcgagguguacacccagagcugcgaccaccggcugaugagcgccgcgaucaaggacgagcgcgccguccacgccgacaugggcuacuggaucgagucccagaagaacgggagcuggaagcucgagaaggccuccuucaucgaggugaagaccugcacguggcccaagagccacacccugugguccaacggcgugcuggagagcgacaugaucauccccaagucccucgccgggcccaucagccagcacaacuaccggccgggcuaccacacccagaccgcggggcccuggcaccugggcaagcuggagcucgacuucaacuacugcgagggcacgaccgucgugaucaccgagaacugcgggacccgcggccccucccugcggacgaccaccgugagcgggaagcugauccacgaguggugcugccgcuccugcacccugccgccccugcgguacaugggcgaggacgggugcugguacggcauggagauccgccccaucaacgagaaggaggagaacauggucaagagccugguguccgccggcagcgggaagguggacaacuucacgaugggcguccucugccuggccauccuguucgaggaggugaugcgggggaaguucggcaagaagcacaugaucgccgggguccuguucaccuucguccugcugcucuccggccagaucaccuggcgcgacauggcccacacccugaucaugaucggcagcaacgcguccgaccggauggggaugggcgugacguaccuggcccucaucgccaccuucaagauccagcccuuccuggcccugggguucuuccuccgcaagcugaccagccgggagaaccugcuccugggcgugggccuggccauggcgaccacgcuccagcugcccgaggacaucgagcagauggccaacgggaucgcccugggccucaugacccugaagcugaucacccaguucgagaccuaccagcucuggacggcccuggucagccugaccugcuccaacaccaucuucacccucacgguggcguggcgcaccgccacccugauccuggccggggucagccuccugccccugugccaguccagcuccaugcggaagaccgacuggcuccccaugacgguggccgccaugggcgugccgccccucccgcuguucaucuucagccucaaggacacccccaagcgccgcuccuggccccugaacgagggggucauggcggugggccuggugagcauccucgccuccagccugcugcggaacgacguccccauggccggcccgcucguggccgggggccugcugaucgccugcuacgugaucaccgggaccuccgcggaccucacggucgagaaggccgccgacgugaccugggaggaggaggccgagcagaccggcgugagccacaaccugaugaucaccgucgacgacgacgggaccaugcgcaucaaggacgacgagacggagaacauccugaccgugcuccugaagaccgcccugcucaucguguccggcaucuuccccuacagcauccccgcgacccugcuggucuggcacacguggcagaagcagacccagcgguccggcgugcucugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgccguccugacccacaacgggaagcgccucgagcccaacugggccuccgugaagaaggaccugaucagcuacggcgggggcuggcggcuguccgcccaguggcagaagggggaggaggugcaggucaucgcgguggagcccggcaagaacccgaagaacuuccagaccaugcccggcaucuuccagacgaccaccggggagaucggcgccaucgcccuggacuucaagcccgggaccagcggcagcccgaucaucaaccgcgagggcaagguggucgggcucuacggcaacgggguggugacgaagaacggcggguacgucuccggcaucgcccagaccaacgcggagcccgacggccccacccccgagcuggaggaggagauguucaagaagcggaaccugaccaucauggaccuccacccggggagcggcaagacgcgcaaguaccugcccgccaucgugcgggaggccaucaagcgccggcugcgcacccucauccuggcccccacccggguggucgccgcggagauggaggaggcccugaaggggcuccccauccgcuaccagaccacggccaccaaguccgagcacaccggccgggagaucguggaccugaugugccacgccaccuucacgaugcgccugcucagcccggugcggguccccaacuacaaccuggugaucauggacgaggcccacuucaccgaccccgcguccaucgccgcccgcggguacaucagcacccgggugggcaugggcgaggccgccgcgaucuucaugaccgccacgcccccggggaccgccgaggccuucccccaguccaacgcgcccauccaggacgaggagcgcgacauccccgagcgcagcuggaacuccggcaacgaguggaucaccgacuucgucgggaagaccgugugguucgugccgagcaucaaggccggcaacgacaucgccaacugccugcggaagaacgggaagaaggucauccagcucucccgcaagacguucgacaccgaguaccagaagacccggcugaacgacugggacuucguggugaccacggacaucagcgagaugggcgccaacuucaaggccgaccgcgucaucgacccccggcgcugccugaagcccgugauccucaccgacggccccgagcgggugauccuggcggggccgaugcccgucaccgccgccuccgccgcccagcgccggggccgcguggggcggaacccccagaaggagaacgaccaguacaucuucaccggccagccccugaacaacgacgaggaccacgcgcacuggaccgaggccaagaugcuccuggacaacaucaacacgccggaggggaucauccccgcccuguucgagcccgagcgcgagaaguccgccgccaucgacggcgaguaccggcucaagggcgagucccgcaagaccuucgucgagcugaugcggcgcggggaccugcccguguggcucgcgcacaagguggccagcgagggcaucaaguacaccgaccggaaguggugcuucgacggggagcgcaacaaccagauccuggaggagaacauggacgucgagaucuggaccaaggagggcgagcggaagaagcugcgcccgcgcuggcucgacgcccggacguacuccgacccccuggcccugaaggaguucaaggacuucgcggccggccgcaagagcaucgcccucgaccuggugaccgagaucgggcgggugcccucccaccuggcccaccgcacccggaacgcccucgacaaccuggucaugcugcacaccagcgagcacggcgggcgcgcguaccggcacgccguggaggagcucccggagacgauggagacccugcugcuccugggccugaugaucagccucaccgggggcgccaugcuguuccugaucuccggcaaggggaucggcaagaccagcaucgggcucaucugcgugaucgucuccagcggcaugcuguggauggccgacgugccccugcaguggaucgccuccgcgaucgugcucgaguucuucaugaugguccugcugauccccgagcccgagaagcagcgcacgccgcaggacaaccagcucgccuacguggugaucgggauccugacccuggccgccaucgucgccgcgaacgagaugggccuccuggagaccaccaagcgggaccugggcaugagcaaggagcccgggguggugucccccacgagcuaccucgacgucgaccugcaccccgccuccgccuggacccuguacgccguggccaccaccgugaucacgccgaugcuccgccacaccaucgagaacagcaccgcgaacgucucccuggccgccaucgccaaccaggcgguggugcugaugggccucgacaagggguggcccaucagcaagauggaccugggcgucccccugcucgcccuggggugcuacucccaggugaacccccugacccucacggccgccgugcugcugcucgucacccacuacgccaucaucggcccgggccugcaggcgaaggccacccgggaggcccagaagcgcaccgccgccgggaucaugaagaaccccacgguggacggcaucaugaccaucgaccuggaccccgugaucuacgacagcaaguucgagaagcagcucgggcaggucaugcugcuggugcucugcgcggugcagcugcugcucaugcggaccuccugggcccugugcgaggcccugacccucgccacgggccccaucaccacccugugggagggcagcccggggaaguucuggaacaccacgaucgccgucuccauggcgaacaucuuccgcggcagcuaccuggccggggccggccucgccuucuccaucaugaaguccguggggaccggccggcgcggcaccgggagccagggcgagacccugggggagaaguggaagaagaagcugaaccagcucucccggaaggaguucgaccuguacaagaaguccggcaucaccgagguggaccgcacggaggcgaaggaggggcugaagcggggcgagaccacccaccacgccgucucccgcggcagcgccaagcuccagugguucguggagcggaacauggugauccccgaggggcgcgucaucgaccugggcugcgggcgcggcgggugguccuacuacugcgccggccugaagaaggugaccgaggugcggggcuacacgaagggcgggcccgggcacgaggagcccgucccgaugagcaccuacggcuggaacaucgugaagcucauguccgggaaggacguguucuaccugccgcccgagaagugcgacacccugcugugcgacaucggcgagagcucccccagcccgaccgucgaggagaaccgcacgauccgggugcucaagaugguggagcccuggcugcgcaacaaccaguucugcaucaagguccugaaccccuacaugcccaccgugaucgagcaccucgagcggcugcagcgcaaguacggcgggaugcuggugcggaacccgcucucccgcaacagcacccacgagauguacuggaucuccaacggcaccgggaacaucgucagcuccgugaacauggucagccggcugcugcucaaccgcuucacgaugacccaccggcgccccaccaucgagaaggacguggaccugggcgccggcacccggcacgugaacgcggagcccgagacgccgaacauggacgucaucggggagcgcaucaagcggaucaaggaggagcacuccagcaccuggcacuacgacgacgagaaccccuacaagaccugggccuaccacggcuccuacgaggugaaggccaccgggagcgccagcuccaugaucaacggcguggucaagcugcucacgaagcccugggacguggugcccauggucacccagauggccaugaccgacaccacgccguucgggcagcagcgcguguucaaggagaagguggacacccggacgccccggcccaugcccggcacccggaaggucauggagaucacggcggaguggcuguggcgcacccugggccgcaacaagaagccgcggcucugcacccgcgaggaguucaccaagaaggugcggacgaacgccgccaugggggccguguucaccgaggagaaccagugggacagcgcccgcgcggccgucgaggacgaggaguucuggaagcugguggaccgggagcgcgagcugcacaagcucggcaagugcggguccugcguguacaacaugaugggcaagcgggagaagaagcugggggaguucggcaaggccaagggcagccgcgccaucugguacauguggcugggggcgcgguaccucgaguucgaggcccugggcuuccugaacgaggaccacugguucucccgcgagaacagcuacuccggggucgagggcgaggggcuccacaagcugggcuacauccugcgggacaucagcaagauccccggcggggccauguacgccgacgacaccgccggcugggacacccgcaucacggaggacgaccuccacaacgaggagaagaucacccagcagauggaccccgagcaccggcagcuggcgaacgccaucuucaagcugaccuaccagaacaagguggugaagguccagcgccccaccccgaaggggaccgugauggacaucaucucccggaaggaccagcgcggcagcggccagguggggacguacggccucaacaccuucaccaacauggaggcccagcugguccggcagauggagggggagggcgugcuguccaaggccgaccucgagaacccccaccuccuggagaagaagaucacccaguggcucgagacgaaggggguggagcgccugaagcggauggccaucagcggcgacgacugcgucgugaagcccaucgacgaccgcuucgcgaacgcccugcucgcccugaacgacaugggcaaggugcggaaggacaucccccaguggcagccguccaagggguggcacgacuggcagcagguccccuucugcagccaccacuuccacgagcugaucaugaaggacggccgcaagcucguggugcccugccgcccccaggacgagcugaucgggcgggcccgcaucucccagggcgccggguggagccugaaggagaccgcgugccucggcaaggccuacgcccagauguggucccugauguacuuccaccggcgcgaccugcggcucgccagcaacgccaucugcuccgcggucccggugcacuggauccccaccagccgcaccacguggagcauccacgcccaccaccaguggaugaccaccgaggacaugcugaccguguggaaccgggucuggaucgaggacaaccccuggauggaggacaagacgcccgugaccaccugggaggacgugccguaccugggcaagcgcgaggaccaguggugcgggucccucaucggccugaccagccgggccacgugggcccagaacauccugaccgcgauccagcagguccgcucccucaucggggacgaggaguuccuggacuacaugcccagcaugaagcgguuccgcaaggaggaggaguccgagggcgccaucugguga

SEQ ID NO: 9946 - RNA, 9873 nt, Artificial Sequence
  derived and/or modified CDS sequence (opt1) from DENV-3__GU131938__SS-prME
accagccugugccucaugaugaugcugcccgccacccuggccuuccaccucaccagccgcgacggcgagccccggaugaucguggggaagaacgagcgcggcaagagccugcuguucaagaccgcguccgggaucaacaugugcacccucaucgccauggaccugggcgagaugugcgacgacaccgucacguacaagugcccccugaucgccgagguggagcccgaggacaucgacugcuggugcaaccucaccagcaccugggugaccuacgggaccugcaaccaggccggcgagcaccggcgcgacaagcgguccgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgaguccaucgagggcaaggugguccaguacgagaaccugaaguacacggugaucaucaccgugcacaccggggaccagcaccaggucggcaacgacacccagggggugacggucgagaucacgccccaggccagcaccguggaggccgugcugcccgaguacggcacccucgggcuggagugcagcccccggaccggccuggacuucaacgagaugauccuccugacgaugaagaacaaggcguggaugguccaccggcagugguucuucgaccugccgcuccccuggaccagcggcgccaccaccgagacgcccaccuggaaccgcaaggagcugcuggugaccuucaagaacgcccacgccaagaagcaggagguggucgugcucgggucccaggagggcgccaugcacaccgcgcugacgggggccaccgagauccagaacagcggcgggaccuccaucuucgccggccaccugaagugccggcucaagauggacaagcuggagcugaagggcaugagcuacgccaugugccucaacaccuucgugcugaagaaggaggucagcgagacgcagcacgggaccauccugaucaagguggaguacaagggcgaggacgcccccugcaagaucccguucuccaccgaggacgggcagggcaaggcgcacaacggccgccugaucaccgccaaccccguggucacgaagaaggaggagcccgugaacaucgaggccgagcccccguucggggagagcaacaucgugaucggcaucggggacaaggcccucaagaucaacugguacaagaagggcuccagcaucgggaagauguucgaggcgaccgcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucacguggaucggccugaacagcaagaacaccuccaugagcuucuccugcaucgugaucgggaucaucacccuguaccucggcgccgucgugcaggccgacauggggugcgugaucaacuggaagggcaaggagcugaagugcggcaacgggaucuucgucaccaacgaggugcacacguggaccgagcaguacaaguuccaggccgacagccccaagcgccuggcgaccgccaucgccggcgccugggagaacggggugugcggcauccgcuccaccacgcggauggagaaccuccuguggaagcagaucgccaacgagcugaacuacauccucugggagaacaacaucaagcugaccgucguggugggggacaucaucggcguccuggagcagggcaagcgcgcgcucacgccccagcccauggagcugaaguacagcuggaagaccugggggaaggccaagaucgugacggccgagacccagaacuccagcuucaucaucgacggcccgaacacccccgagugccccuccgccagccgggcguggaacgugugggaggucgaggacuacggguucggcguguucaccacgaacaucuggcugaagcuccgcgagguguacacccagagcugcgaccaccggcugauguccgccgccaucaaggacgagcgcgccguccacgccgacaugggcuacuggaucgagagccagaagaacggguccuggaagcuggagaaggcgagcuucaucgaggugaagaccugcaccuggcccaagucccacacccucuggagcaacggcgugcuggaguccgacaugaucauccccaagucccuggccgggcccaucucccagcacaaccaccggcccggcuaccacacgcagaccgccgggccguggcaccucggcaagcuggagcuggacuucaacuacugcgagggcaccaccgucgugaucgccgagaacugcgggacgcgcggccccagccuccggaccaccaccguguccgggaagcugauccacgaguggugcugccgcagcugcacgcugccgccccugcgguacaugggcgaggacgggugcugguacggcauggagauccgcccgaucaacgagaaggaggagaacauggucaagucccuggugagcgccggcuccgggaagguggacaacuucaccaugggcguccugugccucgcgauccuguucgaggaggugaugcgggggaaguucggcaagaagcacaugaucgccggggugcuguucaccuucguccuccugcugagcggccagaucaccuggcgcgacauggcccacacgcucaucaugaucggcuccaacgccagcgaccggauggggaugggcgugaccuaccuggcccugaucgcgaccuucaagauccagcccuuccucgcccugggguucuuccugcgcaagcucaccagccgggagaaccugcugcucggcgugggccuggccauggccacgacccugcagcuccccgaggacaucgagcagauggcgaacgggaucgcccugggccugaugacccucaagcugaucacccaguucgagacguaccagcuguggaccgcccucgucucccugaccugcagcaacaccaucuucacgcugaccguggccuggcgcaccgccacccucauccuggcgggggucucccugcucccccugugccagagcuccagcaugcggaagacggacuggcugccgaugaccguggccgccaugggcgugccgccccucccccuguucaucuucucccugaaggacaccccgaagcgccgcagcuggccccucaacgagggggucauggccgugggccugguguccauccuggccagcucccuccugcggaacgacguccccauggcgggcccccugguggccgggggccuccugaucgccugcuacgugaucaccgggacgagcgccgaccugaccgucgagaaggccgcggacgugaccugggaggaggaggccgagcagaccggcgugucccacaaccucaugaucacggucgacgacgacgggaccaugaagaucaaggacgacgagaccgagaacauccugaccgugcugcucaagaccgcccugcugaucgugagcggcaucuucccguacuccauccccgccacgcuccuggucuggcacaccuggcagaagcagacccagcgcagcggcgugcugugggacgugcccagcccgcccgagacccagaaggccgagcucgaggagggggucuaccggaucaagcagcagggcaucuucgggaagacccaggugggcguggggguccagaaggagggcguguuccacaccauguggcacgugacccgcggcgcgguccugacccacaacgggaagcggcuggagcccaacugggccagcgugaagaaggaccucaucuccuacggcgggggcuggcgccugagcgcccaguggcagaagggggaggaggugcaggucaucgccguggagcccggcaagaaccccaagaacuuccagacgaugcccggcaucuuccagaccaccaccggggagaucggcgcgaucgcccuggacuucaagcccgggacgagcggcucccccaucaucaaccgggagggcaagguggucgggcuguacggcaacgggguggugaccaagaacggcggguacgucagcggcaucgcccagaccaacgccgagccggacggccccacccccgagcucgaggaggagauguucaagaagcgcaaccugacgaucauggaccugcaccccggguccggcaagacccggaaguaccucccggccaucgugcgcgaggcgaucaagcggcgccugcggacccugauccucgcccccacccgcguggucgccgccgagauggaggaggcccugaaggggcugcccauccgguaccagacgaccgcgaccaagagcgagcacaccggccgcgagaucguggaccucaugugccacgccacguucaccaugcggcugcugucccccgugcgcgucccgaacuacaaccucgugaucauggacgaggcccacuucaccgaccccgccagcaucgccgcgcggggguacaucuccacccgcgugggcaugggcgaggccgccgccaucuucaugacggcgacgccgcccgggaccgccgaggccuucccgcagagcaacgcccccauccaggacgaggagcgggacauccccgagcgcuccuggaacagcggcaacgaguggaucaccgacuucgucgggaagacggugugguucgugcccuccaucaaggccggcaacgacaucgcgaacugccugcgcaagaacgggaagaaggucauccagcugagccggaagaccuucgacaccgaguaccagaagacccgccucaacgacugggacuucguggugacgaccgacaucuccgagaugggcgccaacuucaaggccgaccgggucaucgacccgcgccggugccugaagcccgugauccugaccgacggccccgagcgcgugauccucgccgggcccaugccggucaccgccgcgagcgccgcccagcggcgcggccggguggggcgcaacccccagaaggagaacgaccaguacaucuucaugggccagccccugaacaacgacgaggaccacgcccacuggacggaggccaagaugcugcucgacaacaucaacacccccgaggcgaucaucccggcccuguucgagcccgagcgggagaaguccgccgccaucgacggggaguaccgccugaagggcgagagccggaagaccuucgucgagcucaugcgccggggcgaccugcccguguggcuggcgcacaagguggccuccgaggggaucaaguacaccgaccgcaaguggugcuucgacggcgagcggaacaaccagauccucgaggagaacauggacgucgagaucuggaccaaggagggggagcgcaagaagcugcggccccgcuggcuggacgcccgcacguacagcgacccgcucgcccugaaggaguucaaggacuucgccgcgggccggaaguccaucgcccuggaccucgugaccgagaucggccgcgugcccagccaccuggcccaccggacccgcaacgcccuggacaaccucgucaugcugcacaccagcgagcacgggggccgggccuaccgccacgcgguggaggagcugcccgagacgauggagacccuccugcugcucgggcugaugauccugcucaccggcggggccaugcuguuccugaucuccggcaagggcaucgggaagaccagcaucggccucaucugcgugaucgucuccagcgggaugcuguggauggccgacgugccgcugcaguggaucgccuccgccaucgugcucgaguucuucaugaugguccugcugauccccgagcccgagaagcagcggacgccccaggacaaccagcucgcguacguggugaucggcauccugacccuggccgccaucgucgccgccaacgagauggggcuccuggagaccaccaagcgcgaccugggcaugagcaaggagccgggcguggugucccccacgagcuaccucgacgucgaccugcaccccgcguccgccuggacccuguacgccguggccaccaccgugaucacgcccaugcuccggcacaccaucgagaacagcaccgcgaacgucucccuggccgccaucgccaaccaggccguggugcugauggggcucgacaagggcuggccgaucagcaagauggaccugggggucccccugcucgcgcugggcugcuacucccaggugaacccccugacccucacggccgccgugcugcugcucgucacccacuacgccaucaucgggcccggccugcaggccaaggcgacccgcgaggcccagaagcggaccgccgccggcaucaugaagaacccgacgguggacgggaucaugaccaucgaccuggaccccgugaucuacgacagcaaguucgagaagcagcucggccaggucaugcugcuggugcucugcgccgugcagcugcugcucaugcgcaccuccugggcgcugugcgaggcccugacccucgccacggggcccaucaccacccugugggagggcagccccggcaaguucuggaacaccacgaucgccgucuccauggcgaacaucuuccgggggagcuaccuggccggcgccgggcucgccuucuccaucaugaaguccgugggcaccgggcgccggggcaccggcagccagggggagacccugggcgagaaguggaagaagaagcugaaccagcucucccgcaaggaguucgaccuguacaagaaguccgggaucacggagguggaccggaccgaggccaaggagggccugaagcgcggggagaccacccaccacgcggucucccggggcagcgccaagcuccagugguucguggagcgcaacauggugaucccggagggccgggucaucgaccuggggugcggccgcgggggcugguccuacuacugcgccgggcugaagaaggugaccgaggugcgcggcuacacgaagggcgggcccggccacgaggagcccguccccaugagcaccuacggguggaacaucgugaagcucauguccggcaaggacguguucuaccugccgcccgagaagugcgacacccugcugugcgacaucggggagagcucccccagccccaccgucgaggagucccggacgauccgcgugcucaagaugguggagccguggcugcggagcaaccaguucugcaucaagguccugaaccccuacaugcccaccgugaucgagcaccucgagcgccugcagcggaaguacggcggcaugcuggugcgcaacccccucucccggaacagcacccacgagauguacuggaucuccaacgggaccggcaacaucgucagcuccgugaacauggucagccgccugcugcucaaccgguucacgaugacccaccgccggccgaccaucgagaaggacguggaccugggggccggcacccgccacgugaacgccgagcccgagacgcccaacauggacgucaucggcgagcggaucaagcgcaucaaggaggagcacuccagcaccuggcacuacgacgacgagaacccguacaagaccugggcguaccacgggagcuacgaggugaaggccaccggcuccgccagcuccaugaucaacgggguggucaagcugcucacgaagcccugggacguggugcccauggucacccagauggccaugaccgacaccacgcccuucggccagcagcggguguucaaggagaagguggacacccgcaccccgcggcccaugcccgggacccgcaaggucauggagaucacggccgaguggcuguggcggacccugggccgcaacaagaagccccgccucugcacccgggaggaguucaccaagaaggugcgcacgaacgcggccaugggcgccguguucaccgaggagaaccagugggacagcgcccgggcggccgucgaggacgaggaguucuggaagcugguggacaaggagcgcgagcugcacaagcucgggaagugcggcuccugcguguacaacaugauggggaagcgggagaagaagcugggcgaguucgggaaggccaagggcagccgcgccaucugguacauguggcugggcgcccgguaccucgaguucgaggcgcugggguuccugaacgaggaccacugguucucccgcgagaacagcuacuccggcgucgagggggagggccuccacaagcugggguacauccugcgggacaucagcaagaucccgggcggcgccauguacgccgacgacaccgccgggugggacacccgcaucacggaggacgaccuccacaacgaggagaagaucacccagcagauggaccccgagcaccggcagcuggccaacgcgaucuucaagcugaccuaccagaacaagguggugaagguccagcgccccacccccaagggcacggugauggacaucaucucccggaaggaccagcgcgggagcggccaggugggcaccuacgggcucaacaccuucaccaacauggaggcccagcugguccggcagauggagggcgagggggugcuguccaaggccgaccucgagaacccgcaccuccuggagaagaagaucacccaguggcucgagacgaagggcguggagcgccugaagcggauggccaucagcggggacgacugcgucgugaagcccaucgacgaccgcuucgccaacgcgcugcucgcccugaacgacaugggcaaggugcggaaggacaucccccaguggcagcccuccaagggcuggcacgacuggcagcaggucccguucugcagccaccacuuccacgagcugaucaugaaggacgggcgcaagcucguggugcccugccggccccaggacgagcugaucggccgcgcccgcaucucccagggggccggcuggagccugaaggagaccgccugccucgggaaggcguacgcccagauguggucccugauguacuuccaccggcgcgaccugcggcucgccagcaacgccaucugcagcgcgguccccgugcacuggaucccgaccucccgcaccacguggagcauccacgcccaccaccaguggaugaccaccgaggacaugcugaccguguggaaccgggucuggaucgaggacaaccccuggauggaggacaagacgcccgugaccaccugggaggacgugcccuaccugggcaagcgcgaggaccaguggugcggcucccucaucgggcugaccagccgggccacgugggcccagaacauccugaccgccauccagcagguccgcucccucaucggcgacgaggaguuccuggacuacaugccgagcaugaagcgguuccgcaaggaggaggagaccgagggggcgaucugguga

SEQ ID NO: 9947 - RNA, 9873 nt, Artificial Sequence
  derived and/or modified CDS sequence (opt1) from DENV-3__GU131939__SS-prME
accagccugugccucaugaugaugcugcccgcgacccuggccuuccaccucaccagccgcgacggcgagccgcggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaagguggagacgugggcccuccgccacccgggguucaccauccuggcgcuguuccucgcccacuacaucggcaccucccugacccagaagguggugaucuucauccugcucaugcuggugacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccaucaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgugggcgggguccugaacucccucggcaagauggugcaccagaucuucgggagcgcguacaccgcccuguucuccggcgugagcuggaucaugaagaucggcaucgggguccugcucacguggaucggccugaacuccaagaacaccagcauguccuucagcugcaucgugaucgggaucaucacccuguaccucggcgccgugguccaggccgacauggggugcgugaucaacuggaagggcaaggagcugaagugcggcaacgggaucuucgugaccaacgagguccacacguggaccgagcaguacaaguuccaggccgacucccccaagcgccuggcgaccgccaucgccggcgccugggagaacggggugugcggcauccgcagcaccacgcggauggagaaccuccuguggaagcagaucgccaacgagcugaacuacauccucugggagaacaacaucaagcugaccguggucgugggggacaucaucggcgugcuggagcagggcaagcgcacccucacgccccagccgauggagcugaaguacuccuggaagacgugggggaaggcgaagaucgucaccgccgagacccagaacagcuccuucaucaucgacggccccaacacccccgagugccccagcgccucccgggccuggaacgugugggagguggaggacuacggguucggcgucuucacgaccaacaucuggcugaagcuccgcgagguguacacccagagcugcgaccaccggcugaugagcgcggccaucaaggacgagcgcgccgugcacgccgacaugggcuacuggaucgagucccagaagaacgggagcuggaagcuggagaaggccuccuucaucgaggucaagaccugcaccuggcccaagagccacacgcucugguccaacggcgugcuggagagcgacaugaucauccccaagucccuggcggggcccaucagccagcacaaccaccggccgggcuaccacacccagaccgccgggcccuggcaccucggcaagcuggagcuggacuucaacuacugcgagggcaccacgguggucaucgccgagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgcgggggugcuguucaccuucgugcuccugcuguccggccagaucacguggcgcgacauggcccacacccucaucaugaucggcagcaacgccuccgaccggauggggaugggcgucaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccgucgccuggcgcaccgccacgcucauccuggccggggugagccugcucccgcugugccaguccagcuccaugcggaagaccgacuggcugcccaugaccgucgcggccaugggcgugccgccccugccgcuguucaucuucagccugaaggacacccccaagcgcaaguccuggccccucaacgagggggugauggccgucggccuggugagcauccuggccuccagccuccugcgcaacgacgugcccauggccggcccgcuggucgccggcgggcuccugaucgccugcuacgugaucacggggaccuccgccgaccugaccguggagaaggccgccgacgucaccugggaggaggaggcggagcagacgggggugagccacaaccucaugaucaccguggacgacgacgggaccaugcggaucaaggacgacgagaccgagaacauccugaccguccugcucaagacggcccugcugaucguguccggcaucuuccccuacagcauccccgccacccuccugguguggcacaccuggcagaagcagacccagcgcuccggcguccugugggacgugcccagcccgcccgagacgcagaaggccgagcucgaggaggggguguaccggaucaagcagcagggcaucuucgggaagacccaggucggcgugggggugcagaaggagggcgucuuccacaccauguggcacgugacccgcggcgccgugcugacgcacaacgggaagcggcuggagcccaacugggcguccgucaagaaggaccucaucagcuacggcgggggcuggcgccuguccgcccaguggcagaagggggaggagguccaggugaucgccgucgagcccggcaagaacccgaagaacuuccagaccaugcccggcaucuuccagaccaccacgggggagaucggcgccaucgcgcuggacuucaagcccgggaccagcggcagcccgaucaucaaccgggagggcaaggugguggggcuguacggcaacggggucgugaccaagaacggcggguacguguccggcaucgcccagaccaacgccgagcccgacggccccacgcccgagcucgaggaggagauguucaagaagcgcaaccugaccaucauggaccugcacccggggagcggcaagacccggaaguaccuccccgccaucguccgcgaggccaucaagcggcgccugcggacccugauccucgcgcccacgcgcgugguggccgccgagauggaggaggcccugaaggggcugcccauccgguaccagaccaccgccaccaaguccgagcacacgggccgcgagaucgucgaccucaugugccacgcgaccuucaccaugcggcugcugagcccggugcgcgugcccaacuacaaccucaucaucauggacgaggcccacuucaccgaccccgccuccaucgccgcccggggguacaucagcacgcgcgucggcaugggcgaggcggccgccaucuucaugaccgccacgccgcccgggaccgcggaggccuucccccaguccaacgcccccauccaggacgaggagcgggacauccccgagcgcagcuggaacuccggcaacgaguggaucacggacuucguggggaagaccgugugguucguccccagcaucaaggccggcaacgacaucgccaacugccugcgcaagaacgggaagcgggugauccagcugucccgcaagaccuucgacaccgaguaccagaagacgcggcucaacgacugggacuucguggucaccaccgacaucagcgagaugggcgcgaacuucaaggccgaccgcgugaucgacccccggcgcugccugaagcccgugauccugaccgacggccccgagcgggucauccucgccgggccgaugcccgugacggccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucgucgagcucaugcggcgcggggaccugcccguguggcuggcccacaaggucgccagcgagggcaucaaguacacggaccggaaguggugcuucgacggggagcgcaacaaccagauccucgaggagaacauggacguggagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcggguccccucccaccuggcgcaccgcacgcggaacgcccuggacaaccucgugaugcugcacaccagcgagcacggcgggcgcgccuaccggcacgccguggaggagcugccggagaccauggagacccuccugcugcucggccugaugauccugcucaccggcggggccaugcuguuccugaucagcgggaaggggaucggcaagaccuccaucgggcucaucugcgucaucgugagcuccggcaugcuguggauggcggacgugccccugcaguggaucgccagcgccaucguccucgaguucuucaugauggugcugcugauccccgagcccgagaagcagcgcaccccgcaggacaaccagcucgccuacguggucaucgggauccugacccuggccgcgaucguggccgccaacgagaugggccuccuggagacgaccaagcgggaccugggcauguccaaggagcccgggguggucagccccaccuccuaccucgacguggaccugcaccccgccagcgccuggacccuguacgcgguggccacgaccgucaucaccccgaugcuccgccacaccaucgagaacuccacggccaacgugagccuggccgcgaucgccaaccaggccgugguccugaugggccucgacaagggguggcccaucuccaagauggaccugggcgugccccugcucgcccuggggugcuacagccaggugaacccccugacccucaccgccgcgguccugcugcucgugacccacuacgccaucaucggcccgggccugcaggccaaggccacgcgggaggcccagaagcgcaccgcggccgggaucaugaagaaccccaccguggacggcaucaugaccaucgaccuggaccccgucaucuacgacuccaaguucgagaagcagcucggccaggugaugcugcuggugcucugcgccguccagcugcugcucaugcggacgagcugggcccugugcgaggcccugacccucgcgaccggccccaucaccacgcugugggagggcuccccggggaaguucuggaacaccaccaucgccgugagcauggccaacaucuuccgcggcuccuaccuggccggggcgggccucgccuucagcaucaugaaguccguggggaccggccggcgcggcacggggagccagggcgagacccugggggagaaguggaagaagaagcugaaccagcucagccggaaggaguucgaccuguacaagaaguccggcaucaccgaggucgaccgcaccgaggccaaggaggggcugaagcggggcgagaccacgcaccacgccgugagccgcggcuccgccaagcuccagugguucguggagcggaacauggucauccccgaggggcgcgugaucgaccugggcugcgggcgcggcggguggagcuacuacugcgcgggccugaagaaggugaccgagguccggggcuacaccaagggcggccccgggcacgaggagcccgugccgauguccaccuacggcuggaacaucgugaagcucaugagcgggaaggacgucuucuaccugccgcccgagaagugcgacacgcugcugugcgacaucggcgaguccagccccuccccgaccguggaggagagccgcaccauccgggugcucaagauggucgagcccuggcugcgcaacaaccaguucugcaucaaggugcugaaccccuacaugcccaacgugaucgagcaccucgagcggcugcagcgcaaguacggcgggaugcugguccggaacccgcucucccgcaacagcacccacgagauguacuggaucuccaacggcacggggaacaucgugagcuccgugaacauggucagccggcugcugcucaaccgcuucaccaugacccaccggcgccccaccaucgagaaggacguggaccugggcgccggcacgcggcacgucaacgccgagcccgagaccccgaacauggacgugaucggggagcgcaucaagcggaucaaggaggagcacuccagcaccuggcacuacgacgacgagaaccccuacaagaccugggccuaccacggcuccuacgaggugaaggccacggggagcgcgagcuccaugaucaacggcgucgugaagcugcucaccaagcccugggacgugguccccauggugacccagauggccaugaccgacacgaccccguucgggcagcagcgcguguucaaggagaaggucgacacccggacgccccggcccaugcccggcacgcggaaggugauggagaucaccgccgaguggcuguggcgcacccugggccgcaacaagaagccgcggcucugcacccgcgaggaguucacgaagaaggugcggaccaacgccgccaugggggcggucuucaccgaggagaaccagugggacagcgcccgcgccgccguggaggacgaggaguucuggaagcugguggacaaggagcgggagcugcacaagcucggcaagugcggguccugcgucuacaacaugaugggcaagcgcgagaagaagcugggggaguucggcaaggcgaagggcagccgggccaucugguacauguggcugggggcccgcuaccucgaguucgaggcccugggcuuccugaacgaggaccacugguucucccgggagaacagcuacuccgggguggagggcgaggggcuccacaagcugggcuacauccugcgcgacaucagcaagauccccggcggggccauguacgcggacgacaccgccggcugggacacgcggaucaccgaggacgaccuccacaacgaggagaagaucacccagcagauggaccccgagcaccgccagcuggccaacgccaucuucaagcugaccuaccagaacaagguggucaaggugcagcggcccacgccgaaggggaccgugauggacaucaucucccgcaaggaccagcggggcagcggccaggucgggaccuacggccucaacaccuucaccaacauggaggcccagcuggugcgccagauggagggggagggcgugcuguccgaggcggaccucgagaacccccaccuccuggagaagaagaucacgcaguggcucgagaccaagggggucgagcggcugaagcgcauggccaucagcggcgacgacugcguggugaagcccaucgacgaccgguucgccaacgcccugcucgcccugaacgacaugggcaagguccgcaaggacaucccccaguggcagccguccaagggguggcacgacuggcagcagguccccuucugcagccaccacuuccacgagcugaucaugaaggacggccggaagcucgugguccccugccgcccccaggacgagcugaucgggcgcgcgcggaucucccagggcgccggguggagccugaaggagaccgccugccucggcaaggccuacgcccagauguggucccugauguacuuccaccgccgggaccugcgccucgcgagcaacgccaucugcuccgccgugccggugcacuggauccccaccagccggacgaccuggagcauccacgcccaccaccaguggaugaccaccgaggacaugcugacggucuggaaccgcguguggaucgaggacaaccccuggauggaggacaagacccccgugaccaccugggaggacgucccguaccugggcaagcgggaggaccaguggugcgggucccucaucggccugacgagccgcgcgaccugggcccagaacauccugaccgccauccagcagguccggucccucaucggggacgaggaguuccuggacuacaugcccagcaugaagcgcuuccggaaggaggaggaguccgagggcgccaucugguga

SEQ ID NO: 9948 - RNA, 9873 nt, Artificial Sequence
  derived and/or modified CDS sequence (opt1) from DENV-3__GU131940__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcggcagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucaccccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcaccgucgugcaggccgacauggggugcgccaucaacuggaagggcaaggagcugaagugcggcuccgggaucuucgugacgaacgagguccacaccuggaccgagcaguacaaguuccaggccgacagccccaagcgccuggcgaccgccaucgccggcgccugggagaacggggugugcggcauccgcuccacgacccggauggagaaccuccuguggaagcagaucgccaacgagcugaacuacauccucugggagaacaacaucaagcugaccguggucgugggggacaucaucggcgugcuggagcagggcaagcgcacccucacgccccagccgauggagcugaaguacagcuggaagaccugggggaaggcgaagaucgucaccgccgagacccagaacuccagcuucaucaucgacggccccaacacgcccgagugccccuccgccagccgggccuggaacgugugggagguggaggacuacggguucggcgucuucaccaccaacaucuggcugaagcuccgcgagguguacacccagagcugcgaccaccggcugauguccgcggccaucaaggacgagcgcgccgugcacgccgacaugggcuacuggaucgagagccagaagaacggguccuggaagcuggagaaggccagcuucaucgaggucaagaccugcacguggccgaagucccacacccucuggagcaacggcgugcuggaguccgacaugaucauccccaagagccuggcggggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucaacgagaaggaggagaacauggugaagucccuggucagcgccggcuccgggaagguggacaacuucacgaugggcgugcugugccucgccauccuguucgaggaggucaugcgggggaaguucggcaagaagcacaugaucgccggggugcuguucaccuucgugcuccugcugagcggccagaucaccuggcgcgacauggcgcacacccucaucaugaucggcuccaacgccagcgaccggauggggaugggcgucacguaccuggcccugaucgccaccuucaagauccagcccuuccucgcccugggguucuuccugcgcaagcucaccagccgggagaaccugcugcucggcgugggccuggcgauggccaccacgcugcagcuccccgaggacaucgagcagauggccaacgggaucgcccugggccugaugacccucaagcugaucacccaguucgagaccuaccagcuguggacggcgcucgugucccugaccugcagcaacaccaucuucacccugacggucgccuggcgcaccgccacccucauccuggccggggugucccugcucccgcugugccagagcuccagcaugcggaagaccgacuggcugcccaugacggucgccgcgaugggcgugcccccccucccgcuguucaucuucucccugaaggacacccccaagcgccgcagcuggccccucaacgagggggugauggccgucggccugguguccauccuggccagcucccuccugcggaacgacgugcccauggccggcccgcuggucgccgggggccuccugaucgcgugcuacgugaucaccgggaccagcgccgaccugacgguggagaaggccgccgacgucaccugggaggaggaggccgagcagaccggcgugucccacaaccucaugaucaccguggacgacgacgggaccaugcgcaucaaggacgacgagacggagaacauccugaccguccugcucaagaccgcgcugcugaucgugagcggcaucuuccccuacuccauccccgccacccuccugguguggcacacguggcagaagcagacccagcggagcggcguccugugggacgugcccuccccgcccgagacccagaaggccgagcucgaggaggggguguaccgcaucaagcagcagggcaucuucgggaagacccaggucggcgugggggugcagaaggagggcgucuuccacacgauguggcacgugacccggggcgccgugcugacccacaacgggaagcgccuggagcccaacugggccagcgucaagaaggaccucaucuccuacggcgggggcuggcggcugaacgcgcaguggcagaagggggaggaggugcaggugaucgccgucgagcccggcaagaacccgaagaacuuccagaccaugcccggcaucuuccagacgaccaccggggagaucggcgccaucgcccuggacuucaagcccgggaccagcggcagcccgaucaucaaccgcgagggcaaggugguggggcuguacggcaacggggucgugacgaagaacggcggguacguguccggcaucgcgcagaccaacgccgagcccgacggccccacccccgagcucgaggaggagauguucaagaagcggaaccugaccaucauggaccugcacccggggagcggcaagacgcgcaaguaccuccccgccaucguccgggaggccaucaagcgccggcugcgcacccugauccucgcccccacccgggugguggcggccgagauggaggaggcccugaaggggcugcccauccgcuaccagaccacggccaccaaguccgagcacaccggccgggagaucgucgaccucaugugccacgccaccuucacgaugcgccugcugagcccggugcgggugcccaacuacaaccucgucaucauggacgaggcgcacuucaccgaccccgccuccaucgccgcccgcggguacaucagcacccgggugggcaugggcgaggccgcggccaucuucaugaccgccacgcccccggggaccgccgaggcguucccccaguccaacgcccccauccaggacgaggagcgcgacauccccgagcgcagcuggaacuccggcaacgaguggaucaccgacuucguggggaagaccgucugguucgugccgagcaucaaggccggcaacgacaucgccaacugccugcggaagaacgggaagaaggugauccagcugucccgcaagacguucgacaccgaguaccagaagacccggcucaacgacugggacuucgucgugaccacggacaucagcgagaugggcgccaacuucaaggcggaccgcgugaucgacccccggcgcugccugaagcccgucauccugaccgacggccccgagcgggugauccucgccgggccgaugcccgugaccgccgccuccgccgcgcagcgccggggccgcgucgggcggaacccccagaaggagaacgaccaguacaucuucaccggccagccccugaacaacgacgaggaccacgcccacuggaccgaggccaagaugcugcucgacaacaucaacacgccggaggggaucauccccgcccuguucgagcccgagcgcgagaagagcgccgcgaucgacggcgaguaccggcugaagggcgagucccgcaagaccuucguggagcucaugcggcgcggggaccugcccgucuggcuggccuacaagguggccagcgagggcaucaaguacaccgaccggaaguggugcuucgacggggagcgcaacaaccagauccucgaggagaacauggacguggagaucuggaccaaggagggcgagcggaagaagcugcgcccgcgcuggcuggacgcccggacguacuccgacccccucgcgcugaaggaguucaaggacuucgccgccggccgcaagagcaucgcccuggaccucgucaccgagaucgggcgggugcccucccaccuggcccaccgcacccggaacgcgcuggacaaccucgugaugcugcacaccagcgagcacggcgggcgcgccuaccggcacgccgucgaggagcugccggagacgauggagacccuccugcugcucggccugaugauccugcucaccgggggcgccaugcuguuccugaucagcggcaaggggaucggcaagaccuccaucgggcucaucugcgugaucgugagcuccggcaugcuguggauggccgacgucccccugcaguggaucgcgagcgccaucgugcucgaguucuucaugauggugcugcugauccccgagcccgagaagcagcgcacgccgcaggacaaccagcucgccuacgucgugaucgggauccugacccuggccgccaucguggcggccaacgagaugggccuccuggagaccaccaagcgggaccugggcauguccaaggagcccggggucgugagccccacguccuaccucgacguggaccugcaccccgccagcgccuggacccuguacgccgucgcgaccaccgugaucacgccgaugcuccgccacaccaucgagaacuccaccgccaacgugagccuggccgccaucgcgaaccaggccgucgugcugaugggccucgacaagggguggcccaucuccaagauggaccugggcgugccccugcucgcccuggggugcuacagccaggucaacccccugacccucacggccgccgugcugcugcucgugacccacuacgcgaucaucggcccgggccugcaggccaaggccacccgggaggcccagaagcgcaccgccgcggggaucaugaagaaccccacggucgacggcaucaugaccaucgaccuggaccccgugaucuacgacuccaaguucgagaagcagcucgggcaggugaugcugcugguccucugcgccgugcagcugcugcucaugcggaccagcugggcccugugcgaggcccugacccucgccacgggccccaucaccacccugugggagggcuccccggggaaguucuggaacaccacgaucgcggugagcauggccaacaucuuccgcggcuccuaccuggccggggccggccucgcguucagcaucaugaaguccgucgggaccggccggcgcggcaccgggagccagggcgagacccugggggagaaguggaagaagaagcugaaccagcucagccggaaggaguucgaccuguacaagaaguccggcaucaccgagguggaccgcacggaggccaaggaggggcugaagcggggcgagaccacccaccacgccgugagccgcggcuccgccaagcuccagugguucgucgagcggaacauggugauccccgaggggcgcgugaucgaccugggcugcgggcgcggcggguggagcuacuacugcgccggccugaagaaggucaccgaggugcggggcuacacgaaggggggccccgggcacgaggagcccgugccgauguccaccuacggcuggaacaucgucaagcucaugagcgggaaggacguguucuaccugccccccgagaagugcgacacccugcugugcgacaucggcgaguccagccccuccccgaccguggaggagagccgcacgauccggguccucaagaugguggagcccuggcugcgcaacaaccaguucugcaucaaggugcugaaccccuacaugcccaccgucaucgagcaccucgagcggcugcagcgcaaguacggcgggaugcuggugcggaacccgcucucccgcaacagcacccacgagauguacuggaucuccaacggcaccgggaacaucgugagcuccgucaacauggugagccggcugcugcucaaccgcuucacgaugacccaccggcgccccaccaucgagaaggacgucgaccugggcgcgggcacccggcacgugaacgccgagcccgagacgccgaacauggacgugaucggggagcgcaucaagcggaucaaggaggagcacuccagcaccuggcacuacgacgacgagaaccccuacaagaccugggccuaccacggcuccuacgaggucaaggccaccgggagcgccagcuccaugaucaacggcguggugaagcugcucacgaagcccugggacgucgugcccauggugacccagauggcgaugaccgacaccacgccguucgggcagcagcgcgucuucaaggagaagguggacacccggaccccccgccccaugcccggcacccggaaggugauggagaucacggccgaguggcuguggcgcacccugggccgcaacaagaagccgcggcucugcacccgcgaggaguucaccaagaagguccggacgaacgccgccaugggggccguguucaccgaggagaaccagugggacagcgcgcgcgccgccguggaggacgaggaguucuggaagcuggucgaccgggagcgcgagcugcacaagcucggcaagugcggguccugcguguacaacaugaugggcaagcgggagaagaagcugggggaguucggcaaggccaagggcagccgcgcgaucugguacauguggcugggggcccgguaccucgaguucgaggcccugggcuuccugaacgaggaccacugguucucccgcgagaacagcuacuccgggguggagggcgaggggcuccacaagcugggcuacauccugcgggacaucagcaagauccccggcggggccauguacgccgacgacaccgcgggcugggacacccgcaucacggaggacgaccuccacaacgaggagaagaucacccagcagauggaccccgagcaccggcagcuggccaacgccaucuucaagcugaccuaccagaacaaggucgugaaggugcagcgccccaccccgaaggggaccgucauggacaucaucucccggaaggaccagcgcggcagcggccagguggggacguacggccucaacaccuucaccaacauggaggcccagcuggugcggcagauggagggggagggcguccuguccaaggccgaccucgagaacccccaccugcuggagaagaagaucacccaguggcucgagacgaaggggguggagcgccugaagcggauggcgaucagcggcgacgacugcguggucaagcccaucgacgaccgcuucgccaacgcccugcucgcccugaacgacaugggcaaggugcggaaggacaucccccaguggcagccguccaagggguggcacgacuggcagcaggugcccuucugcagccaccacuuccacgagcugaucaugaaggacggccgcaagcucgucgugcccugccgcccccaggacgagcugaucgggcgggcccgcaucucccagggcgcgggguggagccugaaggagaccgccugccucggcaaggccuacgcccagauguggucccugauguacuuccaccggcgcgaccugcggcucgccagcaacgcgaucugcuccgccgugccgguccacuggauccccaccagccgcaccacguggagcauccacgcccaccaccaguggaugaccaccgaggacaugcugaccguguggaaccggguguggaucgaggacaaccccuggauggaggacaagacgcccgucaccaccugggaggacgugccguaccugggcaagcgcgaggaccaguggugcgggucccucaucggccugaccagccgggccacgugggcgcagaacauccugaccgccauccagcaggugcgcucccucaucggggacgaggaguuccuggacuacaugcccagcaugaagcgguuccgcaaggaggaggaguccgagggcgccaucugguga

SEQ ID NO: 9949 - RNA, 9873 nt, Artificial Sequence
  derived and/or modified CDS sequence (opt1) from DENV-3__GU131942__SS-prME
accagccugugccucaugaugauguuccccgccacccuggccuuccaccugacgucccgcgacggcgagccgcggaugaucguggggaagaacgagcgcggcaagagccuccuguucaagaccgcguccgggaucaacaugugcacccugaucgccauggaccucggcgagaugugcgacgacaccgucacguacaagugcccccugaucgccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagagcaagcccacccucgacaucgagcugcagaagaccgaggccacccagcuggcgacgcuccggaagcugugcaucgagggcaagaucaccaacaucaccaccgacucccgcugccccacgcagggcgaggccacccugccggaggagcaggaccagaacuacgugugcaagcacaccuacgucgaccggggguggggcaacgggugcggccucuucgggaagggcagccuggugaccugcgccaaguuccagugccuggagcccaucgagggcaaggugguccaguacgagaaccucaaguacacggugaucaucaccgugcacaccggggaccagcaccaggucggcaacgacacccagggggugacggucgagaucaccccccaggccuccaccguggaggccgugcugcccgaguacggcacccuggggcucgagugcagcccgcgcaccggccuggacuucaacgagaugauccugcucacgaugaagaacaaggcguggaugguccaccggcagugguucuucgaccugccccugcccuggaccuccggcgccaccaccgagacgcccaccuggaaccgcaaggagcuccuggugaccuucaagaacgcccacgccaagaagcaggagguggucgugcuggggagccaggagggcgccaugcacaccgcgcucacgggggccaccgagauccagaacuccggcgggaccagcaucuucgccggccaccugaagugccggcugaagauggacaagcucgagcugaagggcauguccuacgccaugugccugaacaccuucgugcucaagaaggaggucagcgagacgcagcacgggaccauccugaucaagguggaguacaagggcgaggacgccccgugcaagauccccuucagcaccgaggacgggcagggcaaggcgcacuccggccgccugaucaccgccaaccccguggucacgaagaaggaggagcccgugaacaucgaggccgagccgcccuucggggagagcaacaucgugaucggcaucggggacaaggcccugaagaucaacugguacaagaagggcuccagcaucgggaagauguucgaggcgaccgcccggggcgcccgccggauggccauccucggcgacaccgccugggacuucggguccgucggcggggugcugaacagccugggcaagauggugcaccagaucuucggguccgcguacaccgcccucuucagcggcgucuccugggugaugaagaucggcaucggggugcugcugacguggaucggccucaacagcaagaacaccuccaugagcuucuccugcaucgucaucgggaucaucacccuguaccugggcgccguggugcaggccgacauggggugcgucaucaacuggaagggcaaggagcucaagugcggcagcgggaucuucgugaccaacgaggugcacacguggaccgagcaguacaaguuccaggccgacucccccaagcgccuggcgaccgccaucgccggcgccugggagaacggggucugcggcauccgcagcaccacgcggauggagaaccugcucuggaagcagaucgccaacgagcugaacuacauccugugggagaacaacaucaagcucaccgugguggucggggacaucaucggcgugcuggagcagggcaagcgcacccugaccccccagccgauggagcucaaguacuccuggaagacgugggggaaggcgaagaucgugaccgccgagacccagaacagcuccuucaucaucgacggccccaacacccccgagugccccagcgccagccgggccuggaacgucugggagguggaggacuacggguucggcguguucacgaccaacaucuggcugaagcugcgcgaggucuacacccaguccugcgaccaccggcucaugagcgcggccaucaaggacgagcgcgccgugcacgccgacaugggcuacuggaucgagucccagaagaacgggagcuggaagcuggagaaggccuccuucaucgaggugaagaccugcaccuggccgaagagccacacgcugugguccaacggcguccucgagagcgacaugaucauccccaagucccuggcggggcccaucagccagcacaaccaccggccgggcuaccacacccagaccgccgggcccuggcaccugggcaagcucgagcuggacuucaacuacugcgagggcaccacgguggugaucaccgagaacugcgggacccgcggccccucccugcggaccacgaccgucagcgggaagcucauccacgaguggugcugccgcuccugcacccugcccccgcugcgguacaugggcgaggacgggugcugguacggcauggagauccgccccaucaacgagaaggaggagaacauggugaagagccucguguccgccggcagcgggaaggucgacaacuucaccaugggcgugcugugccuggccauccucuucgaggaggugaugcgggggaaguucggcaagaagcacaugaucgccgggguccuguucacguucgugcugcuccuguccggccagaucaccuggcgcgacauggcgcacacccugaucaugaucggcagcaacgccagcgaccggauggggaugggcgugaccuaccucgcccugaucgccacguucaagauccagcccuuccuggcccucggguucuuccugcgcaagcugaccucccgggagaaccuccugcugggcgucggccucgcgauggccaccacccugcagcugcccgaggacaucgagcagauggccaacgggaucgcccucggccugaugacgcugaagcucaucacccaguucgagaccuaccagcuguggaccgcgcuggugagccucacgugcuccaacaccgucuucacccugaccguggccuggcgcacggccacccugauccucgccggggugagccugcugccgcucugccaguccagcuccaugcggaagaccgacuggcugcccaugaccgucgccgcgaugggcgugcccccccugccgcucuucaucuucagccugaaggacacgcccaagcgccgcuccuggccccugaacgagggggugauggccgucggccucgugagcauccuggccuccagccugcuccggaacgacgugcccauggccggcccgcuggucgccgggggccugcucaucgcgugcuacgugaucaccgggaccuccgccgaccugaccguggagaaggccgccgacgucacgugggaggaggaggccgagcagaccggcgugagccacaaccugaugaucaccguggacgacgacgggaccaugcgcaucaaggacgacgagaccgagaacauccucacgguccugcugaagaccgcgcuccugaucguguccggcaucuuccccuacagcauccccgccacccugcucguguggcacaccuggcagaagcagacgcagcgguccggcguccugugggacgugcccagcccgcccgagacccagaaggccgagcuggaggaggggguguaccgcaucaagcagcagggcaucuucgggaagacccaggucggcgugggggugcagaaggagggcgucuuccacaccauguggcacgugacgcggggcgccgugcucacccacaacgggaagcgccuggagcccaacugggccuccgucaagaaggaccugaucagcuacggcgggggcuggcggcucaacgcgcaguggcagaagggggaggaggugcaggugaucgccgucgagcccggcaagaacccgaagaacuuccagaccaugcccggcaucuuccagaccacgaccggggagaucggcgccaucgcccuggacuucaagcccgggaccagcggcuccccgaucaucaaccgcgagggcaaggugguggggcuguacggcaacggggucgugaccaagaacggcggguacgugagcggcaucgcgcagacgaacgccgagcccgacggccccacccccgagcuggaggaggagauguucaagaagcggaaccucaccaucauggaccugcacccgggguccggcaagacccgcaaguaccugcccgccaucguccgggaggccaucaagcgccggcuccgcacgcugauccuggcccccacccgggugguggcggccgagauggaggaggcccucaaggggcugcccauccgcuaccagaccaccgccacgaagagcgagcacaccggccgggagaucgucgaccugaugugccacgccaccuucaccaugcgccuccuguccccggugcgggugcccaacuacaaccuggucaucauggacgaggcgcacuucacggaccccgccagcaucgccgcccgcggguacaucuccacccgggugggcaugggcgaggccgcggccaucuucaugaccgccacccccccggggacggccgaggcguucccccagagcaacgcccccauccaggacgaggagcgcgacauccccgagcgcuccuggaacagcggcaacgaguggaucaccgacuucguggggaagaccgucugguucgugccguccaucaaggccggcaacgacaucgccaacugccuccggaagaacgggaagaaggugauccagcugagccgcaagaccuucgacacggaguaccagaagacccggcugaacgacugggacuucgucgugaccaccgacaucuccgagaugggcgccaacuucaaggcggaccgcgugaucgacccccggcgcugccucaagcccgucauccugacggacggccccgagcgggugauccuggccgggccgaugcccgucaccgccgccagcgccgcgcagcgccggggccgcguggggcggaacccccagaaggagaacgaccaguacaucuucaccggccagccccucaacaacgacgaggaccacgcccacuggaccgaggccaagaugcugcuggacaacaucaacaccccggaggggaucauccccgcccucuucgagcccgagcgcgagaaguccgccgcgaucgacggcgaguaccggcugaagggcgagagccgcaagacguucguggagcugaugcggcgcggggaccuccccgucuggcuggcccacaagguggccuccgagggcaucaaguacaccgaccggaaguggugcuucgacggggagcgcaacaaccagauccuggaggagaacauggacguggagaucuggaccaaggagggcgagcggaagaagcuccgcccgcgcuggcuggacgcccggaccuacagcgacccccuggcgcucaaggaguucaaggacuucgccgccggccgcaaguccaucgcccuggaccuggucacggagaucgggcgggugcccagccaccucgcccaccgcacccggaacgcgcuggacaaccuggugaugcuccacaccagcgagcacggcgggcgcgccuaccggcacgccgucgaggagcugccggagaccauggagacgcugcuccugcugggccucaugauccugcugaccgggggcgccaugcucuuccugaucuccggcaaggggaucggcaagaccagcaucgggcugaucugcgugaucguguccagcggcaugcucuggauggccgacgucccccugcaguggaucgcguccgccaucgugcuggaguucuucaugauggugcuccugauccccgagcccgagaagcagcgcaccccgcaggacaaccagcuggccuacgucgugaucgggauccucacgcuggccgccaucguggcggccaacgagaugggccugcucgagaccaccaagcgggaccugggcaugagcaaggagcccggggucgugucccccaccagcuaccuggacguggaccuccaccccgccuccgccuggacgcuguacgccgucgcgaccaccgugaucaccccgaugcugcgccacacgaucgagaacagcaccgccaacgugucccucgccgccaucgcgaaccaggccgucgugcugaugggccuggacaagggguggcccaucagcaagauggaccucggcgugccccugcuggcccucgggugcuacucccaggucaacccccugacccugaccgccgccgugcuccugcuggugacgcacuacgcgaucaucggcccgggccuccaggccaaggccacccgggaggcccagaagcgcaccgccgcggggaucaugaagaaccccaccgucgacggcaucaugacgaucgaccuggaccccgugaucuacgacagcaaguucgagaagcagcuggggcaggugaugcuccugguccugugcgccgugcagcuccugcugaugcggaccuccugggcccucugcgaggcccugacccuggccaccggccccaucacgacccucugggagggcagcccggggaaguucuggaacaccaccaucgcgguguccauggccaacaucuuccgcggcagcuaccuggccggggccggccuggcguucuccaucaugaagagcgucggggccggccggcgcggcacggggagccagggcgagacccucggggagaaguggaagaagaagcugaaccagcugucccggaaggaguucgaccucuacaagaagagcggcaucaccgagguggaccgcaccgaggccaaggaggggcugaagcggggcgagaccacgcaccacgccgugucccgcggcagcgccaagcugcagugguucgucgagcggaacauggugauccccgaggggcgcgugaucgaccucggcugcgggcgcggcgggugguccuacuacugcgcgggccugaagaaggucaccgaggugcggggcuacaccaaggggggccccgggcacgaggagcccgugccgaugagcaccuacggcuggaacaucgucaagcugauguccgggaaggacguguucuaccucccccccgagaagugcgacacgcugcugugcgacaucggcgagagcucccccagcccgaccguggaggagucccgcaccauccggguccugaagaugguggagcccuggcuccgcaacaaccaguucugcaucaaggugcugaaccccuacaugcccaccgucaucgagcaccuggagcggcuccagcgcaaguacggcgggaugcuggugcggaacccgcugagccgcaacuccacgcacgagauguacuggaucagcaacggcaccgggaacaucgucuccagcgugaacauggugucccggcuccugcugaaccgcuucaccaugacccaccggcgccccacgaucgagaaggacgucgaccucggcgccggcacccggcacgugaacgccgagcccgagaccccgaacauggacgugaucggggagcgcaucaagcggaucaaggaggagcacagcuccaccuggcacuacgacgacgagaaccccuacaagacgugggccuaccacggcagcuacgaggucaaggccaccgggagcgcguccagcaugaucaacggcguggugaagcugcugaccaagcccugggacgucgugcccauggugacccagauggccaugacggacaccaccccguucgggcagcagcgcgucuucaaggagaagguggacacccggacgccccgccccaugcccggcacccggaaggugauggagaucaccgccgaguggcucuggcgcacccugggccgcaacaagaagccgcggcugugcacgcgcgaggaguucaccaagaagguccggaccaacgccgccaugggggcgguguucaccgaggagaaccagugggacuccgcccgcgccgccguggaggacgaggaguucuggaagcucgucgaccgggagcgcgagcugcacaagcugggcaagugcgggagcugcguguacaacaugaugggcaagcgggagaagaagcucggggaguucggcaaggcgaagggcucccgcgccaucugguacauguggcugggggcccgguaccuggaguucgaggcccucggcuuccugaacgaggaccacugguucagccgcgagaacuccuacagcgggguggagggcgaggggcugcacaagcucggcuacauccugcgggacaucuccaagauccccggcggggccauguacgcggacgacacggccggcugggacacccgcaucaccgaggacgaccugcacaacgaggagaagaucacccagcagauggaccccgagcaccggcagcucgccaacgccaucuucaagcugacguaccagaacaaggucgugaaggugcagcgccccaccccgaaggggaccgucauggacaucaucagccggaaggaccagcgcggcuccggccagguggggaccuacggccugaacaccuucacgaacauggaggcccagcucgugcggcagauggagggggagggcguccugagcaaggcggaccuggagaacccccaccuccuggagaagaagaucacccaguggcuggagaccaaggggguggagcgccucaagcggauggccaucuccggcgacgacugcguggucaagcccaucgacgaccgcuucgccaacgcccugcuggcccucaacgacaugggcaaggugcggaaggacaucccccaguggcagccgagcaagggguggcacgacuggcagcaggugcccuucugcucccaccacuuccacgagcugaucaugaaggacggccgcaagcuggucgugcccugccgcccccaggacgagcucaucgggcgggcgcgcaucagccagggcgccggguggucccugaaggagaccgccugccugggcaaggccuacgcccagauguggagccucauguacuuccaccggcgcgaccugcggcuggcguccaacgccaucugcagcgccgugccgguccacuggauccccacgagccgcaccaccugguccauccacgcccaccaccaguggaugaccacggaggacaugcucaccguguggaaccggguguggaucgaggacaaccccuggauggaggacaagacccccgucaccacgugggaggacgugccguaccugggcaagcgcgaggaccaguggugcgggagccugaucggccucaccucccgggcgaccugggcccagaacauccugaccgccauccagcaggugcgcagccugaucggggacgaggaguuccucgacuacaugcccuccaugaagcgguuccgcaaggaggaggagagcgagggcgccaucugguga

SEQ ID NO: 9950 - RNA, 9873 nt, Artificial Sequence
  derived and/or modified CDS sequence (opt1) from DENV-3__GU131943__SS-prME
accagccugugccucaugaugaugcugcccgccacccuggccuuccaccucaccagccgcgacggggagccccggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaagguggagaccugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaucuggaaccgcaaggagcugcuggugaccuucaagaacgcccacgccaagaagcaggagguggucgugcucgggagccaggagggcgccaugcacaccgcgcugaccggggccacggagauccagaacuccggcgggaccagcaucuucgccggccaccugaagugccggcucaagauggacaagcuggagcugaagggcauguccuacgccaugugccucaacaccuucgugcugaagaaggaggucagcgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggaguccaacaucgugaucggcaucggggacaaggcccucaagaucaacugguacaagaagggcagcuccaucgggaagauguucgaggcgacggcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucaccuggaucggccugaacuccaagaacacgagcauguccuucagcugcaucgugaucgggaucaucacccuguaccucggcgccgucgugcaggccgacauggggugcgccaucaacuggaagggcaaggagcugaagugcggcuccgggaucuucgugaccaacgagguccacaccuggacggagcaguacaaguuccaggcggacagccccaagcgccuggccaccgccaucgccggcgccugggagaacggggugugcggcauccgcuccaccacccggauggagaaccuccuguggaagcagaucgcgaacgagcugaacuacauccucugggagaacaacaucaagcugacgguggucgugggggacaucaucggcgugcuggagcagggcaagcgcacccucacgccccagccgauggagcugaaguacagcuggaagaccugggggaaggccaagaucgucacggccgagacccagaacuccagcuucaucaucgacggccccaacacccccgagugccccuccgccagccgggcguggaacgugugggagguggaggacuacggguucggcgucuucaccacgaacaucuggcugaagcuccgcgagguguacacccagagcugcgaccaccggcugauguccgccgccaucaaggacgagcgcgccgugcacgccgacaugggcuacuggaucgagagccagaagaacggguccuggaagcuggagaaggcgagcuucaucgaggucaagaccugcaccuggccgaagucccacacccucuggagcaacggcgugcuggaguccgacaugaucauccccaagagccuggccgggcccaucucccagcacaaccaccggccgggcuaccacacgcagaccgccgggcccuggcaccucggcaagcuggagcuggacuucaacuacugcgagggcaccaccguggucaucacggagaacugcgggacccgcggccccagccuccggaccaccacgguguccgggaagcugauccacgaguggugcugccgcagcugcacccugcccccgcuccgguacaugggcgaggacgggugcugguacggcauggagauccgccccaucaacgagaaggaggagaacauggugaagucccuggucagcgccggcuccgggaagguggacaacuucaccaugggcgugcugugccucgccauccuguucgaggaggucaugcgggggaaguucggcaagaagcacaugaucgcgggggugcuguucaccuucgugcuccugcugagcggccagaucacguggcgcgacauggcccacacccucaucaugaucggcuccaacgccagcgaccggauggggaugggcgucaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcugugggccgcccucgugucccugaccugcagcaacaccaucuucacgcugaccgucgccuggcgcaccgccacccucauccuggcgggggugucccugcucccgcugugccagagcuccagcaugcggaagacggacuggcugcccaugaccgucgccgccaugggcgugccgccccugccgcuguucaucuucucccugaaggacacccccaagcgccgcagcuggccccucaacgagggggugauggccgucggccugguguccauccuggccagcucccuccugcggaacgacgugcccauggcgggcccgcuggucgccgggggccuccugaucgccugcuacgugaucaccgggacgagcgccgaccugaccguggagaaggccgcggacgucaccugggaggaggaggccgagcagaccggcgugucccacaaccucaugaucacgguggacgacgacgggaccaugcgcaucaaggacgacgagaccgagaacauccugaccguccugcucaagaccgcccugcugaucgugagcggcaucuuccccuacuccauccccgccacgcuccugguguggcacaccuggcagaagcagacccagcggagcggcguccugugggacgugcccuccccgcccgagacccagaaggccgagcucgaggaggggguguaccgcaucaagcagcagggcaucuucgggaagacgcaggucggcgugggggugcagaaggagggcgucuuccacaccauguggcacgugacccggggcgcggugcugacccacaacgggaagcgccuggagcccaacugggccagcgucaagaaggaccucaucuccuacggcgggggcuggcggcugaacgcccaguggcagaagggggaggagguccaggugaucgccgucgagcccggcaagaacccgaagaacuuccagacgaugcccggcaucuuccagaccaccaccggggagaucggcgcgaucgcccuggacuucaagcccgggacgagcggcagcccgaucaucaaccgcgagggcaaggugguggggcuguacggcaacggggucgugaccaagaacggcggguacguguccggcaucgcccagaccaacgccgagcccgacggccccacccccgagcucgaggaggagauguucaagaagcggaaccugacgaucauggaccugcacccggggagcggcaagacccgcaaguaccuccccgccaucguccgggaggcgaucaagcgccggcugcgcacccugauccucgcccccacccgggugguggccgccgagauggaggaggcccugaaggggcugcccauccgcuaccagacgaccgcgaccaaguccgagcacaccggccgggagaucgucgaccucaugugccacgccacguucaccaugcgccugcugagcccggugcgggugcccaacuacaaccucgucaucauggacgaggcccacuucaccgaccccgccuccaucgccgcgcgcggguacaucagcacccgggugggcaugggcgaggccgccgccaucuucaugacggcgacgccgcccgggaccgccgaggccuucccccaguccaacgcccccauccaggacgaggagcgcgacauccccgagcgcagcuggaacuccggcaacgaguggaucaccgacuucguggggaagacggucugguucgugcccagcaucaaggccggcaacgacaucgcgaacugccugcggaagaacgggaagaaggugauccagcugucccgcaagaccuucgacaccgaguaccagaagacccggcucaacgacugggacuucgucgugacgaccgacaucagcgagaugggcgccaacuucaaggccgaccgcgugaucgacccccggcgcugccugaagcccgucauccugaccgacggccccgagcgggugauccucgccgggccgaugcccgugaccgccgcguccgccgcccagcgccggggccgcgucgggcggaacccccagaaggagaacgaccaguacaucuucacgggccagccccugaacaacgacgaggaccacgcccacuggaccgaggccaagaugcugcucgacaacaucaacaccccggaggggaucauccccgcgcuguucgagcccgagcgcgagaaguccgccgccaucgacggcgaguaccggcugaagggcgagucccgcaagaccuucguggagcucaugcggcgcggggaccugcccgucuggcuggcccacaagguggcgagcgagggcaucaaguacaccgaccggaaguggugcuucgacggggagcgcaacaaccagauccucgaggagaacauggacguggagaucuggacgaaggagggcgagcggaagaagcugcgcccgcgcuggcuggacgcccggaccuacuccgacccccucgcccugaaggaguucaaggacuucgccgccggccgcaagagcaucgcgcuggaccucgucaccgagaucgggcgggugcccucccaccuggcccaccgcacccggaacgcccuggacaaccucgugaugcugcacacgagcgagcacggcgggcgcgccuaccggcacgccgucgaggagcugccggagaccauggagacccuccugcugcucggccugaugauccugcucaccgggggcgcgaugcuguuccugaucagcggcaaggggaucggcaagacguccaucgggcucaucugcgugaucgugagcuccggcaugcuguggauggccgacgucccccugcaguggaucgccagcgccaucgugcucgaguucuucaugauggugcugcugauccccgagcccgagaagcagcgcaccccgcaggacaaccagcucgccuacgucgugaucgggauccugacccuggcggccaucguggccgccaacgagaugggccuccuggagaccacgaagcgggaccugggcauguccaaggagcccggggucgugagccccaccuccuaccucgacguggaccugcaccccgccagcgcguggacccuguacgccgucgccaccacggugaucaccccgaugcuccgccacaccaucgagaacuccaccgccaacgugagccuggcggccaucgccaaccaggccgucgugcugaugggccucgacaagggguggcccaucuccaagauggaccugggcgugccccugcucgcccuggggugcuacagccaggucaacccccugacgcucaccgcggccgugcugcugcucgugacccacuacgccaucaucggcccgggccugcaggccaaggccacccgggaggcgcagaagcgcacggccgccgggaucaugaagaaccccaccgucgacggcaucaugaccaucgaccuggaccccgugaucuacgacuccaaguucgagaagcagcucggccaggugaugcugcugguccucugcgccgugcagcugcugcucaugcggaccagcugggcccugugcgaggcgcugacgcucgccaccggccccaucaccacccugugggagggcuccccggggaaguucuggaacacgaccaucgccgugagcauggccaacaucuuccgcggcuccuaccuggcgggggccggccucgccuucagcaucaugaaguccgucgggaccggccggcgcggcaccgggagccagggcgagacgcugggggagaaguggaagaagaagcugaaccagcucagccggaaggaguucgaccuguacaagaaguccggcaucaccgagguggaccgcaccgaggccaaggaggggcugaagcggggcgagaccacccaccacgccgugagccgcggcuccgcgaagcuccagugguucgucgagcggaacauggugauccccgaggggcgcgugaucgaccugggcugcgggcgcggcggguggagcuacuacugcgccggccugaagaaggucacggaggugcggggcuacaccaagggcgggcccgggcacgaggagcccgugccgauguccaccuacggcuggaacaucgucaagcucaugagcgggaaggacguguucuaccugccgcccgagaagugcgacacccugcugugcgacaucggcgaguccagccccuccccgacgguggaggagagccgcaccauccggguccucaagaugguggagcccuggcugcgcaacaaccaguucugcaucaaggugcugaaccccuacaugcccaccgucaucgagcaccucgagcggcugcagcgcaaguacggcgggaugcuggugcggaacccgcucucccgcaacagcacccacgagauguacuggaucuccaacggcacggggaacaucgugagcuccgucaacauggugagccggcugcugcucaaccgcuucaccaugacccaccggcgccccaccaucgagaaggacgucgaccugggcgccggcacgcggcacgugaacgccgagcccgagaccccgaacauggacgugaucggggagcgcaucaagcggaucaaggaggagcacuccagcaccuggcacuacgacgacgagaaccccuacaagaccugggccuaccacggcuccuacgaggucaaggcgacggggagcgccagcuccaugaucaacggcguggugaagcugcucaccaagcccugggacgucgugcccauggugacccagauggccaugaccgacacgaccccguucgggcagcagcgcgucuucaaggagaagguggacacccggacgccccggcccaugcccggcacgcggaaggugauggagaucaccgccgaguggcuguggcgcacccugggccgcaacaagaagccgcggcucugcacccgcgaggaguucacgaagaagguccggaccaacgccgcgaugggggccguguucaccgaggagaaccagugggacagcgcccgcgccgcgguggaggacgaggaguucuggaagcuggucgaccgggagcgcgagcugcacaagcucggcaagugcggguccugcguguacaacaugaugggcaagcgggagaagaagcugggggaguucggcaaggccaagggcagccgcgccaucugguacauguggcugggggcccgguaccucgaguucgaggcccugggcuuccugaacgaggaccacugguucucccgcgagaacagcuacuccgggguggagggcgaggggcuccacaagcugggcuacauccugcgggacaucagcaagauccccggcggggcgauguacgccgacgacaccgccggcugggacacgcgcaucaccgaggacgaccuccacaacgaggagaagaucacccagcagauggaccccgagcaccggcagcuggccaacgccaucuucaagcugaccuaccagaacaaggucgugaaggugcagcgccccacgccgaaggggaccgucauggacaucaucucccggaaggaccagcgcggcagcggccagguggggaccuacggccucaacaccuucaccaacauggaggcgcagcuggugcggcagauggagggggagggcguccuguccaaggccgaccucgagaacccccaccuccuggagaagaagaucacgcaguggcucgagaccaaggggguggagcgccugaagcggauggccaucagcggcgacgacugcguggucaagcccaucgacgaccgcuucgccaacgcccugcucgcgcugaacgacaugggcaaggugcggaaggacaucccccaguggcagccguccaagggguggcacgacuggcagcagguccccuucugcagccaccacuuccacgagcugaucaugaaggacggccgcaagcucgucgugcccugccgcccccaggacgagcugaucgggcgggcccgcaucucccagggcgccggguggagccugaaggagaccgccugccucggcaaggccuacgcgcagauguggucccugauguacuuccaccggcgcgaccugcggcucgccagcaacgccaucugcuccgccgugccgguccacuggauccccaccagccgcacgaccuggagcauccacgcgcaccaccaguggaugaccaccgaggacaugcugacgguguggaaccggguguggaucgaggacaaccccuggauggaggacaagacccccgucaccaccugggaggacgugccguaccugggcaagcgcgaggaccaguggugcgggucccucaucggccugacgagccgggccaccugggcccagaacauccugaccgccauccagcagguccgcucccucaucggggacgaggaguuccuggacuacaugcccagcaugaagcgguuccgcaaggaggaggaguccgagggcgccaucugguga

SEQ ID NO: 9951 - RNA, 9873 nt, Artificial Sequence
  derived and/or modified CDS sequence (opt1) from DENV-3__GU131945__SS-prME
accagccugugccucaugaugaugcugcccgccacccuggccuuccaccucaccagccgggacggcgagccccggaugaucguggggaagaacgagcgcggcaagagccugcuguucaagaccgcguccgggaucaacaugugcacccucaucgccauggaccugggcgagaugugcgacgacaccgucacguacaagugcccccugaucgccgagguggagcccgaggacaucgacugcuggugcaaccucaccagcaccugggugaccuacgggaccugcaaccaggccggcgagcaccggcgcgacaagcgguccgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgaguccaucgagggcaaggugguccaguacgagaaccugaaguacacggugaucaucaccgugcacaccggggaccagcaccaggucggcaacgacacccagggggugacggucgagaucacgccccaggccagcaccguggaggccgugcugcccgaguacggcacccucgggcuggagugcagcccccggaccggccuggacuucaacgagaugauccuccugacgaugaagaacaaggcguggaugguccaccggcagugguucuucgaccugccgcuccccuggaccagcggcgccaccaccgagacgcccaccuggaaccgcaaggagcugcuggugaccuucaagaacgcccacgccaagaagcaggagguggucgugcucgggucccaggagggcgccaugcacaccgcgcugacgggggccaccgagauccagaacagcggcgggaccuccaucuucgccggccaccugaagugccggcucaagauggacaagcuggagcugaagggcaugagcuacgccaugugccucaacaccuucgugcugaagaaggaggucagcgagacgcagcacgggaccauccugaucaagguggaguacaagggcgaggacgcccccugcaagaucccguucuccaccgaggacgggcagggcaaggcgcacaacggccgccugaucaccgccaaccccguggucacgaagaaggaggagcccgugaacaucgaggccgagcccccguucggggagagcaacaucgugaucggcaucggggacaaggcccucaagaucaacugguacaagaagggcuccagcaucgggaagauguucgaggcgaccgcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucacguggaucggccugaacagcaagaacaccuccaugagcuucuccugcaucgugaucgggaucaucacccuguaccucggcgccgucgugcaggccgacauggggugcgugaucaacuggaagggcaaggagcugaagugcggcaacgggaucuucgucaccaacgaggugcacacguggaccgagcaguacaaguuccaggccgacagccccaagcgccuggcgaccgccaucgccggcgccugggagaacggggugugcggcauccgcuccaccacgcggauggagaaccuccuguggaagcagaucgccaacgagcugaacuacauccucugggagaacaacaucaagcugaccgucguggugggggacaucaucggcguccuggagcagggcaagcgcgcgcucacgccccagcccauggagcugaaguacagcuggaagaccugggggaaggccaagaucgugacggccgagacccagaacuccagcuucaucaucgacggcccgaacacccccgagugccccuccgccagccgggcguggaacgugugggaggucgaggacuacggguucggcguguucaccacgaacaucuggcugaagcuccgcgagguguacacccagagcugcgaccaccggcugauguccgccgccaucaaggacgagcgcgccguccacgccgacaugggcuacuggaucgagagccagaagaacggguccuggaagcuggagaaggcgagcuucaucgaggugaagaccugcaccuggcccaagucccacacccucuggagcaacggcgugcuggaguccgacaugaucauccccaagucccuggccgggcccaucucccagcacaaccaccggcccggcuaccacacgcagaccgccgggccguggcaccucggcaagcuggagcuggacuucaacuacugcgagggcaccaccgucgugaucgccgagaacugcgggacgcgcggccccagccuccggaccaccaccguguccgggaagcugauccacgaguggugcugccgcagcugcacgcugccgccccugcgguacaugggcgaggacgggugcugguacggcauggagauccgcccgaucaacgagaaggaggagaacauggucaagucccuggugagcgccggcuccgggaagguggacaacuucaccaugggcguccugugccucgcgauccuguucgaggaggugaugcgggggaaguucggcaagaagcacaugaucgccggggugcuguucaccuucguccuccugcugagcggccagaucaccuggcgcgacauggcccacacgcucaucaugaucggcuccaacgccagcgaccggauggggaugggcgugaccuaccuggcccugaucgcgaccuucaagauccagcccuuccucgcccugggguucuuccugcgcaagcucaccagccgggagaaccugcugcucggcgugggccuggccauggccacgacccugcagcuccccgaggacaucgagcagauggcgaacgggaucgcccugggccugaugacccucaagcugaucacccaguucgagacguaccagcuguggaccgcccucgucucccugaccugcagcaacaccaucuucacgcugaccguggccuggcgcaccgccacccucauccuggcgggggucucccugcucccccugugccagagcuccagcaugcggaagacggacuggcugccgaugaccguggccgccaugggcgugccgccccucccccuguucaucuucucccugaaggacaccccgaagcgccgcagcuggccccucaacgagggggucauggccgugggccugguguccauccuggccagcucccuccugcggaacgacguccccauggcgggcccccugguggccgggggccuccugaucgccugcuacgugaucaccgggacgagcgccgaccugaccgucgagaaggccgcggacgugaccugggaggaggaggccgagcagaccggcgugucccacaaccucaugaucacggucgacgacgacgggaccaugaagaucaaggacgacgagaccgagaacauccugaccgugcugcucaagaccgcccugcugaucgugagcggcaucuucccguacuccauccccgccacgcuccuggucuggcacaccuggcagaagcagacccagcgcagcggcgugcugugggacgugcccagcccgcccgagacccagaaggccgagcucgaggagggggucuaccggaucaagcagcagggcaucuucgggaagacccaggugggcguggggguccagaaggagggcguguuccacaccauguggcacgugacccgcggcgcgguccugacccacaacgggaagcggcuggagcccaacugggccagcgugaagaaggaccucaucuccuacggcgggggcuggcgccugagcgcccaguggcagaagggggaggaggugcaggucaucgccguggagcccggcaagaaccccaagaacuuccagacgaugcccggcaucuuccagaccaccaccggggagaucggcgcgaucgcccuggacuucaagcccgggacgagcggcucccccaucaucaaccgggagggcaagguggucgggcuguacggcaacgggguggugaccaagaacggcggguacgucagcggcaucgcccagaccaacgccgagccggacggccccacccccgagcucgaggaggagauguucaagaagcgcaaccugacgaucauggaccugcaccccggguccggcaagacccggaaguaccucccggccaucgugcgcgaggcgaucaagcggcgccugcggacccugauccucgcccccacccgcguggucgccgccgagauggaggaggcccugaaggggcugcccauccgguaccagacgaccgcgaccaagagcgagcacaccggccgcgagaucguggaccucaugugccacgccacguucaccaugcggcugcugucccccgugcgcgucccgaacuacaaccucgugaucauggacgaggcccacuucaccgaccccgccagcaucgccgcgcggggguacaucuccacccgcgugggcaugggcgaggccgccgccaucuucaugacggcgacgccgcccgggaccgccgaggccuucccgcagagcaacgcccccauccaggacgaggagcgggacauccccgagcgcuccuggaacagcggcaacgaguggaucaccgacuucgucgggaagacggugugguucgugcccuccaucaaggccggcaacgacaucgcgaacugccugcgcaagaacgggaagaaggucauccagcugagccggaagaccuucgacaccgaguaccagaagacccgccucaacgacugggacuucguggugacgaccgacaucuccgagaugggcgccaacuucaaggccgaccgggucaucgacccgcgccggugccugaagcccgugauccugaccgacggccccgagcgcgugauccucgccgggcccaugccggucaccgccgcgagcgccgcccagcggcgcggccggguggggcgcaacccccagaaggagaacgaccaguacaucuucaugggccagccccugaacaacgacgaggaccacgcccacuggacggaggccaagaugcugcucgacaacaucaacacccccgaggggaucaucccggcgcuguucgagcccgagcgggagaaguccgccgccaucgacggcgaguaccgccugaagggcgagagccggaagaccuucgucgagcucaugcgccgcggggaccugcccguguggcuggcccacaagguggcguccgagggcaucaaguacaccgaccgcaaguggugcuucgacggggagcggaacaaccagauccucgaggagaacauggacgucgagaucuggaccaaggagggcgagcgcaagaagcugcggccccgcuggcuggacgcccgcacguacagcgacccgcucgcccugaaggaguucaaggacuucgccgccggccggaaguccaucgcgcuggaccucgugaccgagaucgggcgcgugcccagccaccuggcccaccggacccgcaacgcccuggacaaccucgucaugcugcacaccagcgagcacggcgggcgggccuaccgccacgccguggaggagcugcccgagacgauggagacccuccugcugcucggccugaugauccugcucaccgggggcgcgaugcuguuccugaucuccggcaaggggaucggcaagaccagcaucgggcucaucugcgugaucgucuccagcggcaugcuguggauggccgacgugccgcugcaguggaucgccuccgccaucgugcucgaguucuucaugaugguccugcugauccccgagcccgagaagcagcggacgccccaggacaaccagcucgccuacguggugaucgggauccugacccuggcggccaucgucgccgccaacgagaugggccuccuggagaccaccaagcgcgaccugggcaugagcaaggagccggggguggugucccccacgagcuaccucgacgucgaccugcaccccgccuccgcguggacccuguacgccguggccaccaccgugaucacgcccaugcuccggcacaccaucgagaacagcaccgccaacgucucccuggcggccaucgccaaccaggccguggugcugaugggccucgacaagggguggccgaucagcaagauggaccugggcgucccccugcucgcccuggggugcuacucccaggugaacccccugacccucacggcggccgugcugcugcucgucacccacuacgccaucaucggccccggccugcaggccaaggccacccgcgaggcgcagaagcggaccgccgccgggaucaugaagaacccgacgguggacggcaucaugaccaucgaccuggaccccgugaucuacgacagcaaguucgagaagcagcucgggcaggucaugcugcuggugcucugcgccgugcagcugcugcucaugcgcaccuccugggcccugugcgaggcgcugacccucgccacgggccccaucaccacccugugggagggcagccccgggaaguucuggaacaccacgaucgccgucuccauggccaacaucuuccggggcagcuaccuggcgggggccggccucgccuucuccaucaugaaguccguggggaccggccgccggggcaccgggagccagggcgagacccugggggagaaguggaagaagaagcugaaccagcucucccgcaaggaguucgaccuguacaagaaguccggcaucacggagguggaccggaccgaggccaaggaggggcugaagcgcggcgagaccacccaccacgccgucucccggggcagcgcgaagcuccagugguucguggagcgcaacauggugaucccggaggggcgggucaucgaccugggcugcgggcgcggcgggugguccuacuacugcgccggccugaagaaggugaccgaggugcgcggcuacacgaagggcgggcccgggcacgaggagcccguccccaugagcaccuacggcuggaacaucgugaagcucauguccgggaaggacguguucuaccugccgcccgagaagugcgacacccugcugugcgacaucggcgagagcucccccagccccaccgucgaggagucccggacgauccgcgugcucaagaugguggagccguggcugcggagcaaccaguucugcaucaagguccugaaccccuacaugcccaccgugaucgaguaccucgagcgccugcagcggaaguacggcgggaugcuggugcgcaacccccucucccggaacagcacccacgagauguacuggaucuccaacggcaccgggaacaucgucagcuccgugaacauggucagccgccugcugcucaaccgguucacgaugacccaccgccggccgaccaucgagaaggacguggaccugggcgccggcacccgccacgugaacgccgagcccgagacgcccaacauggacgucaucggggagcggaucaagcgcaucaaggaggagcacuccagcaccuggcacuacgacgacgagaacccguacaagaccugggccuaccacggcagcuacgaggugaaggcgaccggguccgccagcuccaugaucaacggcguggucaagcugcucacgaagcccugggacguggugcccauggucacccagauggccaugaccgacaccacgcccuucgggcagcagcggguguucaaggagaagguggacacccgcaccccgcggcccaugcccggcacccgcaaggucauggagaucacggccgaguggcuguggcggacccugggccgcaacaagaagccccgccucugcacccgggaggaguucaccaagaaggugcgcacgaacgccgcgaugggggccguguucaccgaggagaaccagugggacagcgcccgggccgcggucgaggacgaggaguucuggaagcugguggacaaggagcgcgagcugcacaagcucggcaagugcggguccugcguguacaacaugaugggcaagcgggagaagaagcugggggaguucggcaaggccaagggcagccgcgccaucugguacauguggcugggggcccgguaccucgaguucgaggcccugggcuuccugaacgaggaccacugguucucccgcgagaacagcuacuccggggucgagggcgaggggcuccacaagcugggcuacauccugcgggacaucagcaagaucccgggcggggcgauguacgccgacgacaccgccggcugggacacccgcaucacggaggacgaccuccacaacgaggagaagaucacccagcagauggaccccgagcaccggcagcuggccaacgccaucuucaagcugaccuaccagaacaagguggugaagguccagcgccccacccccaaggggacggugauggacaucaucucccggaaggaccagcgcggcagcggccagguggggaccuacggccucaacaccuucaccaacauggaggcgcagcugguccggcagauggagggggagggcgugcuguccaaggccgaccucgagaacccgcaccuccuggagaagaagaucacccaguggcucgagacgaaggggguggagcgccugaagcggauggccaucagcggcgacgacugcgucgugaagcccaucgacgaccgcuucgccaacgcccugcucgcgcugaacgacaugggcaaggugcggaaggacaucccccaguggcagcccuccaagggguggcacgacuggcagcaggucccguucugcagccaccacuuccacgagcugaucaugaaggacggccgcaagcucguggugcccugccggccccaggacgagcugaucgggcgcgcccgcaucucccagggcgccggguggagccugaaggagaccgccugccucggcaaggccuacgcgcagauguggucccugauguacuuccaccggcgcgaccugcggcucgccagcaacgccaucugcagcgccguccccgugcacuggaucccgaccucccgcaccacguggagcauccacgcgcaccaccaguggaugaccaccgaggacaugcugaccguguggaaccgggucuggaucgaggacaaccccuggauggaggacaagacgcccgugaccaccugggaggacgugcccuaccugggcaagcgcgaggaccaguggugcgggucccucaucggccugaccagccgggccacgugggcccagaacauccugaccgccauccagcagguccgcucccucaucggggacgaggaguuccuggacuacaugccgagcaugaagcgguuccgcaaggaggaggagaccgagggcgccaucugguga

SEQ ID NO: 9952 - RNA, 9873 nt, Artificial Sequence
  derived and/or modified CDS sequence (opt1) from DENV-3__GU131946__SS-prME
accagccugugccucaugaugaugcugcccgccacccuggccuuccaccucaccagccgggacggggagccccggaugaucguggggaagaacgagcggggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcgggauccugaacucccucggcaagauggugcaccagaucuucgggagcgcguacaccgcccuguucuccggcgugagcuggaucaugaagaucggcaucgggguccugcucacguggaucggccugaacuccaagaacaccagcauguccuucagcugcaucgugaucgggaucaucacccuguaccucggcgccgugguccaggccgacauggggugcgugaucaacuggaagggcaaggagcugaagugcggcuccgggaucuucgugaccaacgagguccacacguggaccgagcaguacaaguuccaggccgacagccccaagcgccuggcgaccgccaucgccggcgccugggagaacggggugugcggcauccgcuccaccacgcggauggagaaccuccuguggaagcagaucgccaacgagcugaacuacauccucugggagaacaacaucaagcugaccguggucgugggggacaucaucggcgugcuggagcagggcaagcgcacccucacgccccagccgauggagcugaaguacagcuggaagacgugggggaaggcgcggaucgucaccgccgagacccagaacuccagcuucaucaucgacggccccaacacccccgagugccccuccgccagccgcgccuggaacgugugggagguggaggacuacggguucggcgucuucacgaccaacaucuggcugaagcuccgggagguguacacccagagcugcgaccaccgccugauguccgcggccaucaaggacgagcgggccgugcacgccgacaugggcuacuggaucgagagccagaagaacggguccuggaagcuggagaaggccagcuucaucgaggucaagaccugcaccuggccgaagucccacacgcucuggagcaacggcgugcuggaguccgacaugaucauccccaagagccuggcggggcccaucucccagcacaaccaccgcccgggcuaccacacccagaccgccgggcccuggcaccucggcaagcuggagcuggacuucaacuacugcgagggcaccacgguggucaucaccgagaacugcgggacccggggccccagccuccgcaccacgaccguguccgggaagcugauccacgaguggugcugccggagcugcacccugcccccgcuccgcuacaugggcgaggacgggugcugguacggcauggagauccggcccaucaacgagaaggaggagaacauggugaagucccuggucagcgccggcuccgggaagguggacaacuucaccaugggcgugcugugccucgccauccuguucgaggaggucaugcgcgggaaguucggcaagaagcacaugaucgccggggugcuguucacguucgugcuccugcugagcggccagaucaccuggcgggacauggcgcacacccucaucaugaucggcuccaacgccagcgaccgcauggggaugggcgucaccuaccuggcccugaucgccacguucaagauccagcccuuccucgcccugggguucuuccugcggaagcucaccagccgcgagaaccugcugcucggcgugggccuggcgauggccaccacccugcagcuccccgaggacaucgagcagauggccaacgggaucgcccugggccugaugacgcucaagcugaucacccaguucgagaccuaccagcuguggaccgcgcucgugucccugacgugcagcaacaccaucuucacccugaccgucgccuggcggacggccacccucauccuggccggggugucccugcucccgcugugccagagcuccagcaugcgcaagaccgacuggcugcccaugaccgucgccgcgaugggcgugccgccccugccgcuguucaucuucucccugaaggacacgcccaagcgccggagcuggccccucaacgagggggugauggccgucggccugguguccauccuggccagcucccuccugcgcaacgacgugcccauggccggcccgcuggucgccgggggccuccugaucgcgugcuacgugaucaccgggaccagcgccgaccugaccguggagaaggccgccgacgucacgugggaggaggaggccgagcagaccggcgugucccacaaccucaugaucaccguggacgacgacgggaccaugcggaucaaggacgacgagaccgagaacauccugacgguccugcucaagaccgcgcugcugaucgugagcggcaucuuccccuacuccauccccgccacccuccugguguggcacaccuggcagaagcagacgcagcgcagcggcguccugugggacgugcccuccccgcccgagacccagaaggccgagcucgaggaggggguguaccggaucaagcagcagggcaucuucgggaagacccaggucggcgugggggugcagaaggagggcgucuuccacaccauguggcacgugacgcgcggcgccgugcugacccacaacgggaagcggcuggagcccaacugggccagcgucaagaaggaccucaucuccuacggcgggggcuggcgccugagcgcgcaguggcagaagggggaggagguccaggugaucgccgucgagcccggcaagaacccgaagaacuuccagaccaugcccggcaucuuccagaccacgaccggggagaucggcgccaucgcccuggacuucaagcccgggaccagcggcuccccgaucaucaaccgggagggcaaggugguggggcuguacggcaacggggucgugaccaagaacggcggguacgugagcggcaucgcgcagacgaacgccgagcccgacggccccacccccgagcucgaggaggagauguucaagaagcgcaaccugaccaucauggaccugcacccgggguccggcaagacccggaaguaccuccccgccaucguccgcgaggccaucaagcggcgccugcggacgcugauccucgcccccacccgcgugguggcggccgagauggaggaggcccugaaggggcugcccauccgguaccagaccaccgccaccaagagcgagcacaccggccgcgagaucgucgaccucaugugccacgccaccuucaccaugcggcugcuguccccggugcgcgugcccaacuacaaccucgucaucauggacgaggcgcacuucacggaccccgccagcaucgccgcccggggguacaucuccacccgcgugggcaugggcgaggccgcggccaucuucaugaccgccacgccgcccgggacggccgaggcguucccccagagcaacgcccccauccaggacgaggagcgcgacauccccgagcgguccuggaacagcggcaacgaguggaucaccgacuucguggggaagaccgucugguucgugcccuccaucaaggccggcaacgacaucgccaacugccugcgcaagaacgggaagaaggugauccagcugagccggaagaccuucgacacggaguaccagaagacccgccucaacgacugggacuucgucgugaccaccgacaucuccgagaugggcgccaacuucaaggcggaccgggugaucgacccccgccggugccugaagcccgucauccugacggacggccccgagcgcgugauccucgccgggccgaugcccgugaccgccgccagcgccgcgcagcggcgcggccgggucgggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgccgcgaucgacggcgaguaccgccugaagggcgagagccggaagacguuccucgagcugaugcgccgcggggaccugcccguguggcucgcccacaaggucgccuccgagggcaucaaguacaccgaccgcaaguggugcuucgacggggagcggaacaaccagauccuggaggagaacauggacguggagaucuggaccaaggagggcgagcgcaagaagcugcgcccgcgguggcucgacgcccgcaccuacagcgacccccuggcgcugaaggaguucaaggacuucgccgccggccggaaguccaucgcccucgaccuggugacggagaucgggcgcguccccagccaccuggcccaccggacccgcagcgcgcucgacaaccuggugaugcugcacaccuccgagcacggcgggcgggccuaccgccacgccguggaggagcucccggagaccauggagacgcugcugcuccugggccugaugauccuccugaccgggggcgccaugcuguuccucaucagcggcaaggggaucggcaagaccuccaucgggcugaucugcgucaucgugagcuccggcaugcuguggauggccgacgugccccuccaguggaucgcgagcgccaucguccuggaguucuucaugauggugcugcucauccccgagcccgagaagcagcggaccccgcaggacaaccagcuggccuacguggucaucgggauccugacgcucgccgccaucguggcggccaacgagaugggccugcuggagaccaccaagcgcgaccucggcauguccaaggagcccgggguggucagccccaccuccuaccuggacguggaccugcaccccgccagcgccuggacgcucuacgccguggcgaccaccgucaucaccccgaugcugcggcacacgaucgagaacuccaccgccaacgugagccuggccgccaucgcgaaccaggccgugguccucaugggccuggacaagggguggcccaucuccaagauggaccugggcgugccccuccuggcccuggggugcuacagccaggugaacccccucacccugaccgccgccguccugcuccuggugacgcacuacgcgaucaucggcccgggccugcaggccaaggccacccgcgaggcccagaagcggaccgccgcggggaucaugaagaaccccaccguggacggcaucaugacgaucgaccucgaccccgucaucuacgacuccaaguucgagaagcagcugggccaggugaugcugcucgugcugugcgccguccagcugcuccugaugcgcaccagcugggcccugugcgaggcccucacccuggccaccggccccaucacgacccugugggagggcuccccggggaaguucuggaacaccaccaucgcggugagcauggccaacaucuuccggggcuccuaccucgccggggccggccuggcguucagcaucaugaaguccguggggacgggccgccggggcaccgggucccagggcgagacccugggggagaaguggaagaagaagcucaaccagcugagccgcaaggaguucgaccuguacaagaaguccggcaucaccgaggucgaccggaccgaggccaaggaggggcucaagcgcggcgagacgacccaccacgccgugagccggggcuccgccaagcugcagugguucguggagcgcaacauggucauccccgaggggcgcgugaucgaccugggcugcgggcggggcggguggagcuacuacugcgccggccucaagaaggugaccgagguccgcggcuacaccaagggcgggcccgggcacgaggagcccgugccgauguccacguacggcuggaacaucgugaagcugaugagcgggaaggacgucuucuaccugccgcccgagaagugcgacacccugcucugcgacaucggcgaguccagccccuccccgaccguggaggagagccggaccauccgcgugcugaagauggucgagcccuggcugcggaacaaccaguucugcaucaaggugcucaaccccuacaugcccacggugaucgagcaccuggagcgccugcagcggaaguacggcgggaugcucguccgcaacccgcugucccggaacagcacccacgagauguacuggaucuccaacggcaccgggaacaucgugagcuccgugaacauggucagccgccugcuccugaaccgguucaccaugacgcaccgccggcccaccaucgagaaggacguggaccugggcgcgggcacccgccacgucaacgccgagcccgagaccccgaacauggacgugaucggggagcggaucaagcgcaucaaggaggagcacuccagcacguggcacuacgacgacgagaaccccuacaagaccugggccuaccacggcagcuacgaggugaaggccaccggguccgccagcuccaugaucaacggcgucgugaagcuccugaccaagcccugggacgugguccccauggugacgcagauggcgaugaccgacaccaccccguucgggcagcagcggguguucaaggagaaggucgacacgcgcacgccccggcccaugcccggcacccgcaaggugauggagaucaccgccgaguggcuguggcgcacgcucggccggaacaagaagccgcgccugugcacccgggaggaguucaccaagaaggugcgcaccaacgccgccaugggggccgucuucacggaggagaaccagugggacaacgcgcgggccgccguggaggacgaggaguucuggaagcugguggaccgcgagcgggagcuccacaagcugggcaagugcgggagcugcaucuacaacaugaugggcaagcgcgagaagaagcugggggaguucggcaaggccaagggcucccgggcgaucugguacauguggcucggggcccgcuaccuggaguucgaggcccugggcuuccucaacgaggaccacugguucagccgggagaacuccuacagcggggucgagggcgaggggcugcacaagcugggcuacauccuccgcgacaucuccaagauccccggcggggccauguacgccgacgacaccgcgggcugggacacccggaucaccgaggacgaccugcacaacgaggagaagaucacgcagcagauggaccccgagcaccgccagcuggccaacgccaucuucaagcucaccuaccagaacaagguggugaagguccagcggcccaccccgaaggggaccgugauggacaucaucagccgcaaggaccagcggggcuccggccagguggggaccuacggccugaacacguucaccaacauggaggcccagcugguccgccagauggagggggagggcgugcucagcaaggccgaccuggagaacccccaccuccucgagaagaagaucacccaguggcuggagaccaaggggguggaccggcugaagcgcauggcgaucuccggcgacgacugcgucgugaagcccaucgacgaccgguucgccaacgcccuccuggcccugaacgacaugggcaaggugcgcaaggacaucccccaguggcagccgagcaagggguggcacgacuggcagcagguccccuucugcucccaccacuuccacgagcucaucaugaaggacggccgcaagcugguggugcccugccggccccaggacgagcugaucgggcgcgcccggaucagccagggcgcgggguggucccucaaggagacggccugccugggcaaggccuacgcccagauguggagccugauguacuuccaccgccgggaccuccgccuggccuccaacgcgaucugcagcgccgucccggugcacuggauccccaccagccggaccaccugguccauccacgcccaccaccaguggaugacgaccgaggacaugcugaccguguggaaccgcgucuggaucgaggacaaccccuggauggaggacaagacccccgugacgaccugggaggacgugccguaccucggcaagcgggaggaccaguggugcgggagccugaucggccugaccucccgcgccaccugggcgcagaacauccucacggccauccagcagguccggagccugaucggggacgaggaguuccuggacuacaugcccuccaugaagcgcuuccggaaggaggaggagagcgagggcgccaucugguga

SEQ ID NO: 9953 - RNA, 9873 nt, Artificial Sequence
  derived and/or modified CDS sequence (opt1) from DENV-3__FJ639712__SS-prME
accagccucugccucaugaugauguuccccgccacccuggccuuccaccugacgagccgcgacggcgagccgcggaugaucguggggaagaacgagcgcggcaagagccuccuguucaagaccgcgagcgggaucaacaugugcacccugaucgccauggaccucggcgagaugugcgacgacaccgugaccuacaagugcccccugaucgccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagagcaagcccacccucgacaucgagcugcagaagaccgaggccacccagcuggcgacgcuccggaagcugugcaucgagggcaagaucaccaacaucaccaccgacucccgcugccccacgcagggcgaggccacccugccggaggagcaggaccagaacuacgugugcaagcacaccuacgucgaccggggguggggcaacgggugcggccucuucgggaagggcagccuggugaccugcgccaaguuccagugccuggagcccaucgagggcaaggugguccaguacgagaaccucaaguacacggugaucaucaccgugcacaccggggaccagcaccaggucggcaacgacacccagggggugacggucgagaucacgccccaggccuccaccguggaggccgugcugcccgaguacggcacccuggggcucgagugcagcccgcgcaccggccuggacuucaacgagaugauccugcucacgaugaagaacaaggcguggaugguccaccggcagugguucuucgaccugccccugcccuggaccuccggcgccaccaccgagacgcccaccuggaaccgcaaggagcuccuggugaccuucaagaacgcccacgccaagaagcaggagguggucgugcuggggagccaggagggcgccaugcacaccgcgcucacgggggccaccgagauccagaacuccggcgggaccagcaucuucgccggccaccugaagugccggcugaagauggacaagcucgagcugaagggcauguccuacgccaugugccugaacaccuucgugcucaagaaggaggucagcgagacgcagcacgggaccauccugaucaagguggaguacaagggcgaggacgccccgugcaagauccccuucagcaccgaggacgggcagggcaaggcgcacuccggccgccugaucaccgccaaccccguggucacgaagaaggaggagcccgugaacaucgaggccgagccgcccuucggggagagcaacaucgugaucggcaucggggacaaggcccugaagaucaacugguacaagaagggcuccagcaucgggaagauguucgaggcgaccgcccggggcgcccgccggauggccauccucggcgacaccgccugggacuucggguccgucggcggggugcugaacagccugggcaagauggugcaccagaucuucggguccgcguacaccgcccucuucagcggcgucuccugggugaugaagaucggcaucggggugcugcugacguggaucggccucaacagcaagaacaccuccaugagcuucuccugcaucgucaucgggaucaucacccuguaccugggcgccguggugcaggccgacauggggugcgucaucaacuggaagggcaaggagcucaagugcggcagcgggaucuucgugaccaacgaggugcacacguggaccgagcaguacaaguuccaggccgacucccccaagcgccuggcgaccgccaucgccggcgccugggagaacggggucugcggcauccgcagcaccacgcggauggagaaccugcucuggaagcagaucgccaacgagcugaacuacauccugugggagaacaacaucaagcucaccgugguggucggggacaucaucggcgugcuggagcagggcaagcgcacccugacgccccagccgauggagcucaaguacuccuggaagacgugggggaaggcgaagaucgugaccgccgagacccagaacagcuccuucaucaucgacggccccaacacccccgagugccccagcgccagccgggccuggaacgucugggagguggaggacuacggguucggcguguucacgaccaacaucuggcugaagcugcgcgaggucuacacccaguccugcgaccaccggcucaugagcgcggccaucaaggacgagcgcgccgugcacgccgacaugggcuacuggaucgagucccagaagaacgggagcuggaagcuggagaaggccuccuucaucgaggugaagaccugcaccuggcccaagagccacacgcugugguccaacggcguccucgagagcgacaugaucauccccaagucccuggcggggcccaucagccagcacaaccaccggccgggcuaccacacccagaccgccgggcccuggcaccugggcaagcucgagcuggacuucaacuacugcgagggcaccacgguggugaucaccgagaacugcgggacccgcggccccucccugcggaccacgaccgucagcgggaagcucauccacgaguggugcugccgcuccugcacccugcccccgcugcgguacaugggcgaggacgggugcugguacggcauggagauccgccccaucaacgagaaggaggagaacauggucaagagccucguguccgccggcagcgggaaggucgacaacuucaccaugggcgugcugugccuggccauccucuucgaggaggugaugcgggggaaguucggcaagaagcacaugaucgccgggguccuguucacguucgugcugcuccuguccggccagaucaccuggcgcgacauggcgcacacccugaucaugaucggcagcaacgccagcgaccggauggggaugggcgugaccuaccucgcccugaucgccacguucaagauccagcccuuccuggcccucggguucuuccugcgcaagcugaccucccgggagaaccuccugcugggcgucggccucgcgauggccaccacccugcagcugcccgaggacaucgagcagauggccaacgggaucgcccucggccugaugacgcugaagcucaucacccaguucgagaccuaccagcuguggaccgcgcuggugagccucacgugcuccaacaccaucuucacccugaccgucgccuggcgcacggccacccugauccucgccggggugagccugcugccgcucugccaguccagcuccaugcggaagaccgacuggcugcccaugaccguggccgcgaugggcgugccgccccucccccucuucaucuucagccugaaggacacgcccaagcgccgcuccuggccccugaacgagggggugauggccgugggccucgucagcauccuggccuccagccugcuccggaacgacgugcccauggccggcccgcugguggccgggggccugcucaucgcgugcuacgucaucaccgggaccuccgccgaccugaccguggagaaggccgccgacgugacgugggaggaggaggccgagcagaccggcgucagccacaaccugaugaucaccguggacgacgacgggaccaugcgcaucaaggacgacgagaccgagaacauccucacggugcugcugaagaccgcgcuccugaucgucuccggcaucuuccccuacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgccgugcucacccacaacgggaagcgccuggagcccaacugggccuccgugaagaaggaccugaucagcuacggcgggggcuggcggcucaacgcgcaguggcagaagggggaggagguccaggugaucgccguggagcccggcaagaacccgaagaacuuccagaccaugcccggcaucuuccagaccacgaccggggagaucggcgccaucgcccuggacuucaagcccgggaccagcggcuccccgaucaucaaccgcgagggcaaggucguggggcuguacggcaacgggguggucaccaagaacggcggguacgugagcggcaucgcgcagacgaacgccgagcccgacggccccacccccgagcuggaggaggagauguucaagaagcggaaccucaccaucauggaccugcacccgggguccggcaagacccgcaaguaccugcccgccaucgugcgggaggccaucaagcgccggcuccgcacgcugauccuggcccccacccgggucguggcggccgagauggaggaggcccucaaggggcugcccauccgcuaccagaccaccgccaccaagagcgagcacaccggccgggagaucguggaccugaugugccacgccaccuucaccaugcgccuccuguccccgguccgggugcccaacuacaaccuggugaucauggacgaggcgcacuucacggaccccgccagcaucgccgcccgcggguacaucuccacccgggucggcaugggcgaggccgcggccaucuucaugaccgccacgcccccggggacggccgaggcguucccccagagcaacgcccccauccaggacgaggagcgcgacauccccgagcgcuccuggaacagcggcaacgaguggaucaccgacuucguggggaagaccgugugguucgucccguccaucaaggccggcaacgacaucgccaacugccuccggaagaacgggaagaaggugauccagcugagccgcaagaccuucgacacggaguaccagaagacccggcugaacgagugggacuucguggucaccaccgacaucuccgagaugggcgccaacuucaaggcggaccgcgugaucgacccccggcgcugccucaagcccgugauccugacggacggccccgagcgggucauccuggccgggccgaugcccgugaccgccgccagcgccgcgcagcgccggggccgcgucgggcggaacccccagaaggagaacgaccaguacaucuucaccggccagccccucaacaacgacgaggaccacgcccacuggaccgaggccaagaugcugcuggacaacaucaacaccccggaggggaucauccccgcccucuucgagcccgagcgcgagaaguccgccgcgaucgacggcgaguaccggcugaagggcgagagccgcaagacguucguggagcugaugcggcgcggggaccuccccguguggcuggcccacaaggucgccuccgagggcaucaaguacgccgaccggaaguggugcuucgacggggagcgcaacaaccagauccuggaggagaacauggacguggagaucuggaccaaggagggcgagcggaagaagcuccgcccgcgcuggcuggacgcgcggaccuacagcgacccccuggcccucaaggaguucaaggacuucgccgccggccgcaaguccaucgcccuggaccuggugaccgagaucgggcggguccccagccaccucgcgcaccgcacgcggaacgcccuggacaaccuggugaugcuccacaccagcgagcacggcgggcgcgccuaccggcacgccguggaggagcugccggagaccauggagacccugcuccugcugggccucaugauccugcugaccggcggggccaugcuguuccugaucuccgggaaggggaucggcaagaccagcaucgggcugaucugcgucaucguguccagcggcaugcucuggauggcggacgugccccugcaguggaucgccuccgccaucguccuggaguucuucaugauggugcuccugauccccgagcccgagaagcagcgcaccccgcaggacaaccagcuggccuacguggucaucgggauccucacccuggccgcgaucguggccgccaacgagaugggccugcucgagacgaccaagcgggaccugggcaugagcaaggagcccgggguggucucccccaccagcuaccuggacguggaccuccaccccgccuccgccuggacccuguacgcgguggccacgaccgucaucaccccgaugcugcgccacaccaucgagaacagcacggccaacgugucccucgccgcgaucgccaaccaggccgugguccugaugggccuggacaagggguggcccaucagcaagauggaccucggcgugccccugcuggcccucgggugcuacucccaggugaacccccugacccugaccgccgcgguccuccugcuggugacccacuacgccaucaucggcccgggccuccaggccaaggccacgcgggaggcccagaagcgcaccgcggccgggaucaugaagaaccccaccguggacggcaucaugaccaucgaccuggaccccgucaucuacgacagcaaguucgagaagcagcugggccaggugaugcuccuggugcugugcgccguccagcuccugcugaugcggacguccugggcccucugcgaggcccugacccuggcgaccggccccaucaccacgcucugggagggcagcccggggaaguucuggaacaccaccaucgccguguccauggccaacaucuuccgcggcagcuaccuggccggggcgggccuggccuucuccaucaugaaguccguggggaccggccggcgcggcacggggagccagggcgagacccucggggagaaguggaagaagaagcugaaccagcugucccggaaggaguucgaccucuacaagaaguccggcaucaccgaggucgaccgcaccgaggccaaggaggggcugaagcggggcgagaccacgcaccacgccgugucccgcggcagcgccaagcugcagugguucguggagcggaacauggucauccccgaggggcgcgugaucgaccucggcugcgggcgcggcgggugguccuacuacugcgcgggccugaagaaggugaccgagguccggggcuacaccaagggcgggcccgggcacgaggagcccgugccgaugagcaccuacggcuggaacaucgugaagcugauguccgggaaggacgucuucuaccugccgcccgagaagugcgacacgcugcugugcgacaucggcgagagcucccccagcccgaccguggaggagucccgcaccauccgggugcugaagauggucgagcccuggcuccgcaacaaccaguucugcaucaaggugcugaaccccuacaugcccaccgugaucgagcaccuggagcggcuccagcgcaaguacggcgggaugcugguccggaacccgcugagccgcaacuccacgcacgagauguacuggaucagcaacggcaccgggaacaucguguccagcgucaacauggugucccggcuccugcugaaccgcuucaccaugacccaccggcgccccacgaucgagaaggacguggaccucggcgccggcacccggcacgucaacgccgagcccgagaccccgaacauggacgugaucggggagcgcaucaagcggaucaaggaggagcacagcuccaccuggcacuacgacgacgagaaccccuacaagacgugggccuaccacggcagcuacgaggugaaggccaccgggagcgcguccagcaugaucaacggcgucgugaagcugcugaccaagcccugggacgugguccccauggugacccagauggccaugacggacaccaccccguucgggcagcagcgcguguucaaggagaaggucgacacccggacgccccgccccaugcccggcacccggaaggugauggagaucaccgccgaguggcucuggcgcacccugggccgcaacaagaagccgcggcugugcacgcgcgaggaguucaccaagaaggugcggaccaacgccgccaugggggcggucuucaccgaggagaaccagugggacuccgcccgcgccgccguggaggacgaggaguucuggaagcucguggaccgggagcgcgagcugcacaagcugggcaagugcgggagcugcgucuacaacaugaugggcaagcgggagaagaagcucggggaguucggcaaggcgaagggcucccgcgccaucugguacauguggcugggggcccgguaccuggaguucgaggcccucggcuuccugaacgaggaccacugguucagccgcgagaacuccuacagcgggguggagggcgaggggcugcacaagcucggcuacauccugcgggacaucuccaagauccccggcggggccauguacgcggacgacacggccggcugggacacccgcaucaccgaggacgaccugcacaacgaggagaagaucacccagcagauggaccccgagcaccggcagcucgccaacgccaucuucaagcugacguaccagaacaagguggucaaggugcagcgccccaccccgaaggggaccgugauggacaucaucagccggaaggaccagcgcggcuccggccaggucgggaccuacggccugaacaccuucacgaacauggaggcccagcucgugcggcagauggagggggagggcgugcugagcaaggcggaccuggagaacccccaccuccuggagaagaagaucacccaguggcuggagaccaagggggucgagcgccucaagcggauggccaucuccggcgacgacugcguggugaagcccaucgacgaccgcuucgccaacgcccugcuggcccucaacgacaugggcaagguccggaaggacaucccccaguggcagccgagcaagggguggcacgacuggcagcagguccccuucugcucccaccacuuccacgagcugaucaugaaggacggccgcaagcuggugguccccugccgcccccaggacgagcucaucgggcgggcgcgcaucagccagggcgccggguggucccugaaggagaccgccugccugggcaaggccuacgcccagauguggagccucauguacuuccaccggcgcgaccugcggcuggcguccaacgccaucugcagcgccgugccggugcacuggauccccacgagccgcaccaccugguccauccacgcccaccaccaguggaugaccacggaggacaugcucaccgucuggaaccggguguggaucgaggacaaccccuggauggaggacaagacccccgugaccacgugggaggacgucccguaccugggcaagcgcgaggaccaguggugcgggagccugaucggccucaccucccgggcgaccugggcccagaacauccugaccgccauccagcagguccgcagccugaucggggacgaggaguuccucgacuacaugcccuccaugaagcgguuccgcaaggaggaggagagcgagggcgccaucugguga

SEQ ID NO: 9954 - RNA, 9873 nt, Artificial Sequence
  derived and/or modified CDS sequence (opt1) from DENV-3__FJ639713__SS-prME
accagccugugccucaugaugaugcugcccgcgacccuggccuuccaccucaccagccgcgacggcgagccgcggaugaucguggggaagaacgagcgcggcaagagccugcuguucaagaccgcguccgggaucaacaugugcacccucaucgccauggaccugggcgagaugugcgacgacaccgucaccuacaagugcccccugaucgccgagguggagcccgaggacaucgacugcuggugcaaccucaccagcaccugggugaccuacgggaccugcaaccaggccggcgagcaccggcgcgacaagcgguccgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcaacgggaucuucgucaccaacgaggugcacacguggaccgagcaguacaaguuccaggccgacucccccaagcgccuggcgaccgccaucgccggcgccugggagaacggggugugcggcauccgcagcaccacgcggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacuccuggaagacgugggggaaggcgaagaucgugaccgccgagacccagaacagcuccuucaucaucgacggccccaacacccccgagugccccagcgccucccgggccuggaacgugugggaggucgaggacuacggguucggcguguucacgaccaacaucuggcugaagcuccgcgagguguacacccagagcugcgaccaccggcugaugagcgcggccaucaaggacgagcgcgccguccacgccgacaugggcuacuggaucgagucccagaagaacgggagcuggaagcuggagaaggccuccuucaucgaggugaagaccugcaccuggcccaagagccacacgcucugguccaacggcgugcuggagagcgacaugaucauccccaagucccuggcggggcccaucagccagcacaaccaccggccgggcuaccacacccagaccgccgggcccuggcaccucggcaagcuggagcuggacuucaacuacugcgagggcaccacggucgugaucgccgagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgcgggggugcuguucaccuucguccuccugcuguccggccagaucacguggcgcgacauggcccacacccucaucaugaucggcagcaacgccuccgaccggauggggaugggcgugaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgucagccugaccugcuccaacacgaucuucacccugaccguggccuggcgcaccgccacgcucauccuggccggggucagccugcucccgcugugccaguccagcuccaugcggaagaccgacuggcugcccaugaccguggcggccaugggcgugccgccccugccgcuguucaucuucagccugaaggacacccccaagcgccgcuccuggccccucaacgagggggucauggccgugggccuggugagcauccuggccuccagccuccugcggaacgacguccccauggccggcccgcugguggccggcgggcuccugaucgccugcuacgugaucacggggaccuccgccgaccugaccgucgagaaggccgccgacgugaccugggaggaggaggcggagcagacgggggugagccacaaccucaugaucaccgucgacgacgacgggaccaugcgcaucaaggacgacgagaccgagaacauccugaccgugcugcucaagacggcccugcugaucguguccggcaucuuccccuacagcauccccgccacccuccuggucuggcacaccuggcagaagcagacccagcgguccggcgugcugugggacgugcccagcccgcccgagacgcagaaggccgagcucgaggagggggucuaccgcaucaagcagcagggcaucuucgggaagacccaggugggcguggggguccagaaggagggcguguuccacaccauguggcacgugacccggggcgccguccugacgcacaacgggaagcgccuggagcccaacugggcguccgugaagaaggaccucaucagcuacggcgggggcuggcggcuguccgcccaguggcagaagggggaggaggugcaggucaucgccguggagcccggcaagaacccgaagaacuuccagaccaugcccggcaucuuccagaccaccacgggggagaucggcgccaucgcgcuggacuucaagcccgggaccagcggcagcccgaucaucaaccgcgagggcaagguggucgggcuguacggcaacgggguggugaccaagaacggcggguacgucuccggcaucgcccagaccaacgccgagcccgacggccccacgcccgagcucgaggaggagauguucaagaagcggaaccugaccaucauggaccugcacccggggagcggcaagacccgcaaguaccuccccgccaucgugcgggaggccaucaagcgccggcugcgcacccugauccucgcgcccacgcggguggucgccgccgagauggaggaggcccugaaggggcugcccauccgcuaccagaccaccgccaccaaguccgagcacacgggccgggagaucguggaccucaugugccacgcgaccuucaccaugcgccugcugagcccggugcggguccccaacuacaaccucgugaucauggacgaggcccacuucaccgaccccgccuccaucgccgcccgcggguacaucagcacgcgggugggcaugggcgaggcggccgccaucuucaugaccgccacgccgcccgggaccgcggaggccuucccccaguccaacgcccccauccaggacgaggagcgcgacauccccgagcgcagcuggaacuccggcaacgaguggaucacggacuucgucgggaagaccgugugguucgugcccagcaucaaggccggcaacgacaucgccaacugccugcggaagaacgggaagaaggucauccagcugucccgcaagaccuucgacaccgaguaccagaagacgcggcucaacgacugggacuucguggugaccaccgacaucagcgagaugggcgcgaacuucaaggccgaccgcgucaucgacccccggcgcugccugaagcccgugauccugaccgacggccccgagcgggugauccucgccgggccgaugcccgucacggccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucgucgagcucaugcggcgcggggaccugcccguguggcuggcccacaagguggccagcgagggcaucaaguacacggaccggaaguggugcuucgacggggagcgcaacaaccagauccucgaggagaacauggacgucgagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcgggugcccucccaccuggcgcaccgcacgcggaacgcccuggacaaccucgucaugcugcacaccagcgagcacggcgggcgcgccuaccggcacgccguggaggagcugccggagaccauggagacccuccugcugcucggccugaugauccugcucaccgggggcgccaugcuguuccugaucagcggcaaggggaucggcaagaccuccaucgggcucaucugcgugaucgucagcuccggcaugcuguggauggcggacgugccccugcaguggaucgccagcgccaucgugcucgaguucuucaugaugguccugcugauccccgagcccgagaagcagcgcaccccgcaggacaaccagcucgccuacguggugaucgggauccugacccuggccgcgaucgucgccgccaacgagaugggccuccuggagacgaccaagcgggaccugggcauguccaaggagcccgggguggugagccccaccuccuaccucgacgucgaccugcaccccgccagcgccuggacccuguacgcgguggccacgaccgugaucaccccgaugcuccgccacaccaucgagaacuccacggccaacgucagccuggccgcgaucgccaaccaggccguggugcugaugggccucgacaagggguggcccaucuccaagauggaccugggcgucccccugcucgcccuggggugcuacagccaggugaacccccugacccucaccgccgcggugcugcugcucgucacccacuacgccaucaucggcccgggccugcaggccaaggccacgcgggaggcccagaagcgcaccgcggccgggaucaugaagaaccccaccguggacggcaucaugaccaucgaccuggaccccgugaucuacgacuccaaguucgagaagcagcucgggcaggucaugcugcuggugcucugcgccgugcagcugcugcucaugcggacgagcugggcccugugcgaggcccugacccucgcgaccggccccaucaccacgcugugggagggcuccccggggaaguucuggaacaccaccaucgccgucagcauggccaacaucuuccgcggcuccuaccuggccggggcgggccucgccuucagcaucaugaaguccguggggaccggccggcgcggcacggggagccagggcgagacccugggggagaaguggaagaagaagcugaaccagcucagccggaaggaguucgaccuguacaagaaguccggcaucaccgagguggaccgcagcgaggccaaggaggggcugaagcggggcgagaccacccaccacgccgucucccgcggcagcgccaagcuccagugguucguggagcggaacauggugauccccgaggggcgcgucaucgaccugggcugcgggcgcggcgggugguccuacuacugcgcgggccugaagaaggugacggaggugcggggcuacaccaagggcggccccgggcacgaggagcccgucccgaugagcaccuacggcuggaacaucgugaagcucauguccgggaaggacguguucuaccugccgcccgagaagugcgacacccugcugugcgacaucggcgagagcucccccagcccgacggucgaggagucccgcaccauccgggugcucaagaugguggagcccuggcugcgcaacaaccaguucugcaucaagguccugaaccccuacaugcccaccgugaucgagcaccucgagcggcugcagcgcaagcacggcgggaugcuggugcggaacccgcucagccgcaacuccacccacgagauguacuggaucagcaacggcacggggaacaucgucuccagcgugaacauggucucccggcugcugcucaaccgcuucaccaugacccaccggcgccccaccaucgagaaggacguggaccugggcgccggcacgcggcacgugaacgccgagcccgagaccccgaacauggacgucaucggggagcgcaucaagcggaucaaggaggagcacagcuccaccuggcacuacgacgacgagaaccccuacaagaccugggccuaccacggcagcuacgaggugaaggccacggggagcgcguccagcaugaucaacggcguggucaagcugcucaccaagcccugggacguggugcccauggucacccagauggccaugaccgacacgaccccguucgggcagcagcgcguguucaaggagaagguggacacccggacgccccggcccaugcccggcacgcggaaggucauggagaucaccgccgaguggcuguggcgcacccugggccgcaacaagaagccgcggcucugcacccgcgaggaguucacgaagaaggugcggaccaacgccgccaugggggcgguguucaccgaggagaaccagugggacuccgcccgcgccgccgucgaggacgaggaguucuggaagcugguggacaaggagcgggagcugcacaagcucggcaagugcgggagcugcguguacaacaugaugggcaagcgcgagaagaagcugggggaguucggcaaggcgaagggcucccgggccaucugguacauguggcugggggcccgcuaccucgaguucgaggcccugggcuuccugaacgaggaccacugguucagccgggagaacuccuacagcggggucgagggcgaggggcuccacaagcugggcuacauccugcgcgacaucuccaagauccccggcggggccauguacgcggacgacaccgccggcugggacacgcggaucaccgaggacgaccuccacaacgaggagaagaucacccagcagauggaccccgagcaccgccagcuggccaacgccaucuucaagcugaccuaccagaacaagguggugaagguccagcggcccacgccgaaggggaccgugauggacaucaucagccgcaaggaccagcggggcuccggccagguggggaccuacggccucaacaccuucaccaacauggaggcccagcugguccgccagauggagggggagggcgugcugagcaaggcggaccucgagaacccccaccuccuggagaagaagaucauccaguggcucgagacgaaggggguggagcggcugaagcgcauggccaucuccggcgacgacugcgucgugaagcccaucgacgaccgguucgccaacgcccugcucgcccugaacgacaugggcaaggugcgcaaggacaucccccaguggcagccgagcaagggguggcacgacuggcagcagguccccuucugcucccaccacuuccacgagcugaucaugaaggacggccggaagcucguggugcccugccgcccccaggacgagcugaucgggcgcgcgcggaucagccagggcgccggguggucccugaaggagaccgccugccucggcaaggccuacgcccagauguggagccugauguacuuccaccgccgggaccugcgccucgcguccaacgccaucugcagcgccgucccggugcacuggauccccaccagccggaccacgugguccauccacgcccaccaccaguggaugaccaccgaggacaugcugagcguguggaaccgcgucuggaucgaggacaaccccuggauggaggacaagacccccgugacgaccugggaggacgugccguaccugggcaagcgggaggaccaguggugcgggucccucaucggccugaccagccgcgcgaccugggcccagaacauccugacggccauccagcagguccggucccucaucggggacgaggaguuccuggacuacaugcccagcaugaagcgcuuccggaaggaggaggaguccgagggcgccaucugguga

SEQ ID NO: 9955 - RNA, 9873 nt, Artificial Sequence
  derived and/or modified CDS sequence (opt1) from DENV-3__FJ639714__SS-prME
accagccugugccucaugaugaugcugcccgcgacccuggccuuccaccucaccagccgggacggcgagccccggaugaucguggggaagaacgagcgcggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcaacgggaucuucgucaccaacgaggugcacacguggaccgagcaguacaaguuccaggccgacucccccaagcgccuggcgaccgccaucgccggcgccugggagagcggggugugcggcauccgcuccaccacgcggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacagcuggaagacgugggggaaggcgaagaucgugaccgccgagacccagaacuccagcuucaucaucgacggccccaacacccccgagugccccuccgccagccgggccuggaacgugugggaggucgaggacuacggguucggcguguucacgaccaacaucuggcugaagcuccgcgagguguacacccagagcugcgaccaccggcugauguccgcggccaucaaggacgagcgcgccguccacgccgacaugggcuacuggaucgagagccagaagaacggguccuggaagcuggagaaggccagcuucaucgaggugaagaccugcaccuggccgaagucccacacgcucuggagcaacggcgugcuggaguccgacaugaucauccccaagagccuggcggggcccaucucccagcacaaccaccggccgggcuaccacacccagaccgccgggcccuggcaccucggcaagcuggagcuggacuucaacuacugcgagggcaccacggucgugaucgccgagaacugcgggacccgcggccccagccuccggaccaccacgguguccgggaagcugauccacgaguggugcugccgcagcugcacccugcccccgcuccgguacaugggcgaggacgggugcugguacggcauggagauccgccccaucaacgagaaggaggagaacauggucaagucccuggugagcgccggcuccgggaagguggacaacuucaccaugggcguccugugccucgccauccuguucgaggaggugaugcgggggaaguucggcaagaagcacaugaucgcgggggugcuguucaccuucguccuccugcugagcggccagaucacguggcgcgacauggcccacacccucaucaugaucggcuccaacgccagcgaccggauggggaugggcgugaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgucucccugaccugcagcaacacgaucuucacccugaccguggccuggcgcaccgccacgcucauccuggccggggucucccugcucccgcugugccagagcuccagcaugcggaagaccgacuggcugcccaugaccguggcggccaugggcgugccgccccugccgcuguucaucuucucccugaaggacacccccaagcgccgcagcuggccccucaacgagggggucauggccgugggccugguguccauccuggccagcucccuccugcggaacgacguccccauggccggcccgcugguggccggcgggcuccugaucgccugcuacgugaucacggggaccagcgccgaccugaccgucgagaaggccgccgacgugaccugggaggaggaggcggagcagacgggggugucccacaaccucaugaucaccgucgacgacgacgggaccaugcgcaucaaggacgacgagaccgagaacauccugaccgugcugcucaagacggcccugcugaucgugagcggcaucuuccccuacuccauccccgccacccuccuggucuggcacaccuggcagaagcagacccagcggagcggcgugcugugggacgugcccuccccgcccgagacgcagaaggccgagcucgaggagggggucuaccgcaucaagcagcagggcaucuucgggaagacccaggugggcguggggguccagaaggagggcguguuccacaccauguggcacgugacccggggcgccguccugacgcacaacgggaagcgccuggagcccaacugggcgagcgugaagaaggaccucaucuccuacggcgggggcuggcggcugagcgcccaguggcagaagggggaggaggugcaggucaucgccguggagcccggcaagaacccgaagaacuuccagaccaugcccggcaucuuccagaccaccacgggggagaucggcgccaucgcgcuggacuucaagcccgggaccagcggcuccccgaucaucaaccgcgagggcaagguggucgggcuguacggcaacgggguggugaccaagaacggcggguacgucagcggcaucgcccagaccaacgccgagcccgacggccccacgcccgagcucgaggaggagauguucaagaagcggaaccugaccaucauggaccugcacccgggguccggcaagacccgcaaguaccuccccgccaucgugcgggaggccaucaagcgccggcugcgcacccugauccucgcgcccacgcggguggucgccgccgagauggaggaggcccugaaggggcugcccauccgcuaccagaccaccgccaccaagagcgagcacacgggccgggagaucguggaccucaugugccacgcgaccuucaccaugcgccugcuguccccggugcggguccccaacuacaaccucgugaucauggacgaggcccacuucaccgaccccgccagcaucgccgcccgcggguacaucuccacgcgggugggcaugggcgaggcggccgccaucuucaugaccgccacgccgcccgggaccgcggaggccuucccccagagcaacgcccccauccaggacgaggagcgcgacauccccgagcgcuccuggaacagcggcaacgaguggaucacggacuucgucgggaagaccgugugguucgugcccuccaucaaggccggcaacgacaucgccaacugccugcggaagaacgggaagaaggucauccagcugagccgcaagaccuucgacaccgaguaccagaagacgcggcucaacgacugggacuucguggugaccaccgacaucuccgagaugggcgcgaacuucaaggccgaccgcgucaucgacccccggcgcugccugaagcccgugauccugaccgacggccccgagcgggugauccucgccgggccgaugcccgucacggccgccagcgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagagccgcaagaccuucgucgagcucaugcggcgcggggaccugcccguguggcuggcccacaagguggccuccgagggcaucaaguacacggaccggaaguggugcuucgacggggagcgcaacaaccagauccucgaggagaacauggacgucgagaucuggaccaaggagggcgagcggaagaagcugcgcccgcgcuggcuggacgcgcggaccuacagcgacccccucgcccugaaggaguucaaggacuucgccgccggccgcaaguccaucgcccuggaccucgugaccgagaucgggcgggugcccagccaccuggcgcaccgcacgcggaacgcccuggacaaccucgucaugcugcacaccagcgagcacggcgggcgcgccuaccggcacgccguggaggagcugccggagaccauggagacccuccugcugcucggccugaugauccugcucaccggcggggccaugcuguuccugaucuccgggaaggggaucggcaagaccagcaucgggcucaucugcgugaucgucuccagcggcaugcuguggauggcggacgugccccugcaguggaucgccuccgccaucgugcucgaguucuucaugaugguccugcugauccccgagcccgagaagcagcgcaccccgcaggacaaccagcucgccuacguggugaucgggauccugacccuggccgcgaucgucgccgccaacgagaugggccuccuggagacgaccaagcgggaccugggcaugagcaaggagcccgggguggugucccccaccagcuaccucgacgucgaccugcaccccgccuccgccuggacccuguacgcgguggccacgaccaucaucaccccgaugcuccgccacaccaucgagaacagcacggccaacgugucccuggccgcgaucgccaaccaggccgucgugcugaugggccucgacaagggguggcccaucagcaagauggaccugggcgugccccugcucgcccuggggugcuacucccaggucaacccccugacccucaccgccgcggugcugcugcucgugacccacuacgccaucaucggcccgggccugcaggccaaggccacgcgggaggcccagaagcgcaccgcggccgggaucaugaagaaccccaccgucgacggcaucaugaccaucgaccuggaccccgugaucuacgacagcaaguucgagaagcagcucggccaggugaugcugcugguccucugcgccgugcagcugcugcucaugcggacguccugggcccugugcgaggcccugacccucgcgaccggccccaucaccacgcugugggagggcagcccggggaaguucuggaacaccaccaucgccguguccauggccaacaucuuccgcggcagcuaccuggccggggcgggccucgccuucuccaucaugaaguccgucgggaccggccggcgcggcacggggagccagggcgagacccugggggagaaguggaagaagaagcugaaccagcucucccggaaggaguucgaccuguacaagaaguccggcaucaccgagguggaccgcaccgaggccaaggaggggcugaagcggggcgagaccacgcaccacgccgugucccgcggcagcgccaagcuccagugguucgucgagcggaacauggugauccccgaggggcgcgugaucgaccugggcugcgggcgcggcgggugguccuacuacugcgcgggccugaagaaggucaccgaggugcggggcuacaccaagggcgggcccgggcacgaggagcccgugccgaugagcaccuacggcuggaacaucgucaagcucauguccgggaaggacguguucuaccugccgcccgagaagugcgacacgcugcugugcgacaucggcgagagcucccccagcccgaccguggaggagucccgcaccauccggguccucaagaugguggagcccuggcugcgcaacaaccaguucugcaucaaggugcugaaccccuacaugcccaccgucaucgagcaccucgagcggcugcagcgcaaguacggcgggaugcuggugcggaacccgcucagccgcaacuccacgcacgagauguacuggaucagcaacggcaccgggaacaucguguccagcgucaacauggugucccggcugcugcucaaccgcuucaccaugacccaccggcgccccacgaucgagaaggacgucgaccugggcgccggcacccggcacgugaacgccgagcccgagaccccgaacauggacgugaucggggagcgcaucaagcggaucaaggaggagcacagcuccaccuggcacuacgacgacgagaaccccuacaagacgugggccuaccacggcagcuacgaggucaaggccaccgggagcgcguccagcaugaucaacggcguggugaagcugcucaccaagcccugggacgucgugcccauggugacccagauggccaugacggacaccaccccguucgggcagcagcgcgucuucaaggagaagguggacacccggacgccccgccccaugcccggcacccggaaggugauggagaucaccgccgaguggcuguggcgcacccugggccgcaacaagaagccgcggcucugcacgcgcgaggaguucaccaagaagguccggaccaacgccgccaugggggcgguguucaccgaggagaaccagugggacuccgcccgcgccgccguggaggacgaggaguucuggaagcuggucgacaaggagcgggagcugcacaagcucggcaagugcgggagcugcguguacaacaugaugggcaagcgcgagaagaagcugggggaguucggcaaggcgaagggcucccgggccaucugguacauguggcugggggcccgcuaccucgaguucgaggcccugggcuuccugaacgaggaccacugguucagccgggagaacuccuacagcgggguggagggcgaggggcuccacaagcugggcuacauccugcgcgacaucuccaagauccccggcggggccauguacgcggacgacacggccggcugggacacccggaucaccgaggacgaccuccacaacgaggagaagaucacccagcagauggaccccgggcaccgccagcuggccaacgccaucuucaagcugacguaccagaacaaggucgugaaggugcagcggcccaccccgaagggcaccgucauggacaucaucagccgcaaggaccagcggggcuccggccaggugggcaccuacgggcucaacaccuucacgaacauggaggcccagcuggugcgccagauggagggcgaggggguccugagcaaggcggaccucgagaacccccaccuccuggagaagaagaucacccaguggcucgagaccaagggcguggagcggcugaagcgcauggccaucuccggcgacgacugcguggucaagcccaucgacgaccgguucgccaacgcccugcucgcccugaacgacauggggaaggugcgcaaggacaucccccaguggcagccgagcaagggcuggcacgacuggcagcagguccccuucugcucccaccacuuccacgagcugaucaugaaggacgggcggaagcucgucgugcccugccgcccccaggacgagcugaucggccgcgcgcggaucagccagggggccggcuggucccugaaggagaccgccugccucggcaaggccuacgcccagauguggagccugauguacuuccaccgccgggaccugcgccucgcguccaacgccaucugcagcgccgugccgguccacuggauccccacgagccggaccaccugguccauccacgcccaccaccaguggaugaccacggaggacaugcugaccguguggaaccgcguguggaucgaggacaaccccuggauggaggacaagacccccgucaccacgugggaggacgugccguaccuggggaagcgggaggaccaguggugcggcagccucaucgggcugaccucccgcgcgaccugggcccagaacauccugaccgccauccagcagguccggagccucaucggcgacgaggaguuccuggacuacaugcccuccaugaagcgcuuccggaaggaggaggagacggagggggccaucugguga

SEQ ID NO: 9956 - RNA, 9873 nt, Artificial Sequence
  derived and/or modified CDS sequence (opt1) from DENV-3__FJ639715__SS-prME
accagccugugccucaugaugaugcugcccgcgacccuggccuuccaccucaccagccgggacggcgagccccggaugaucguggggaagaacgagcggggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaagguggagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccaacaucuucgccggccaccugaagugccggcucaagauggacaagcuggagcugaagggcaugagcuacgccaugugccucaacaccuucgugcugaagaaggaggucuccgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccaucaacaucgaggccgagccgcccuucggggagagcaacaucgugaucggcaucggggacaaggcccucaagaucaacugguacaagaagggcuccagcaucgggaagauguucgaggcgaccgcccggggcgcccgccggauggccauccugggcgacaccgccugggacuucggguccgugggcgggguccugaacagccucggcaagauggugcaccagaucuucggguccgcguacaccgcccuguucagcggcguguccuggaucaugaagaucggcaucgggguccugcucacguggaucggccugaacagcaagaacaccuccaugagcuucuccugcaucgugaucgggaucaucacccuguaccucggcgccgugguccaggccgacauggggugcgugaucaacuggaagggcaaggagcugaagugcggcaacgggaucuucgugaccaacgagguccacacguggaccgagcaguacaaguuccaggccgacagccccaagcgccuggcgaccgccaucgccggcgccugggagaacggggugugcggcauccgcuccaccacgcggauggagaaccuccuguggaagcagaucgccaacgagcugaacuacauccucugggagaacaacaucaagcugaccguggucgugggggacaucaucggcgugcuggagcagggcaagcgcacccucacgccccagccgauggagcugaaguacagcuggaagacgugggggaaggcgaagaucgucaccgccgagacccagaacuccagcuucaucaucgacggccccaacacccccgagugccccuccgccagccgggccuggaacgugugggagguggaggacuacggguucggcgucuucacgaccaacaucuggcugaagcuccgcgagguguacacccaguccugcgaccaccggcugaugagcgcggccaucaaggacgagcgcgccgugcacgccgacaugggcuacuggaucgagagccagaagaacggguccuggaagcuggagaaggccagcuucaucgaggucaagaccugcaccuggccgaagucccacacgcucuggagcaacggcgugcuggaguccgacaugaucauccccaagagccuggcggggcccaucucccagcacaaccaccggccgggcuaccacacccagaccgccgggcccuggcaccucggcaagcuggagcuggacuucaacuacugcgagggcaccacgguggucaucgccgagaacugcgggacccgcggccccagccuccggaccaccacgguguccgggaagcugauccacgaguggugcugccgcagcugcacccugcccccgcuccgguacaugggcgaggacgggugcugguacggcauggagauccgccccaucaacgagaaggaggagaacauggugaagucccuggucagcgccggcuccgggaagguggacaacuucaccaugggcgugcugugccucgccauccuguucgaggaggucaugcgggggaaguucggcaagaagcacaugaucgcgggggugcuguucaccuucgugcuccugcugagcggccagaucacguggcgcgacauggcccacacccucaucaugaucggcuccaacgccagcgaccggauggggaugggcgucaccuaccuggcccugaucgccaccuucaagauccagcccuuccucgcgcugggguucuuccugcgcaagcucacgucccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcagcaacacgaucuucacccugaccgucgccuggcgcaccgccacgcucauccuggccggggugucccugcucccgcugugccagagcuccagcaugcggaagaccgacuggcugcccaugaccgucgcggccaugggcgugccgccccugccgcuguucaucuucucccugaaggacacccccaagcgcaagagcuggccccucaacgagggggugauggccgucggccugguguccauccuggccagcucccuccugcgcaacgacgugcccauggccggcccgcuggucgccggcgggcuccugaucgccugcuacgugaucacggggaccagcgccgaccugaccguggagaaggccgccgacgucaccugggaggaggaggcggagcagacgggggugucccacaaccucaugaucaccguggacgacgacgggaccaugcggaucaaggacgacgagaccgagaacauccugaccguccugcucaagacggcccugcugaucgugagcggcaucuuccccuacuccauccccgccacccuccugguguggcacaccuggcagaagcagacccagcgcagcggcguccugugggacgugcccuccccgcccgagacgcagaaggccgagcucgaggaggggguguaccggaucaagcagcagggcaucuucgggaagacccaggucggcgugggggugcagaaggagggcgucuuccacaccauguggcacgugacccgcggcgccgugcugacgcacaacgggaagcggcuggagcccaacugggcgagcgucaagaaggaccucaucuccuacggcgggggcuggcgccugagcgcccaguggcagaagggggaggagguccaggugaucgccgucgagcccggcaagaacccgaagaacuuccagaccaugcccggcaucuuccagaccaccacgggggagaucggcgccaucgcgcuggacuucaagcccgggaccuccggcagcccgaucaucaaccgggagggcaaggugguggggcuguacggcaacggggucgugaccaagaacggcggguacgugagcggcaucgcccagaccaacgccgagcccgacggccccacgcccgagcucgaggaggagauguucaagaagcgcaaccugaccaucauggaccugcacccgggguccggcaagacccggaaguaccuccccgccaucguccgcgaggccaucaagcggcgccugcggacccugauccucgcgcccacgcgcgugguggccgccgagauggaggaggcccugaaggggcugcccauccgguaccagaccaccgccaccaagagcgagcacacgggccgcgagaucgucgaccucaugugccacgcgaccuucaccaugcggcugcuguccccggugcgcgugcccaacuacaaccucaucaucauggacgaggcccacuucaccgaccccgccagcaucgccgcccggggguacaucuccacgcgcgucggcaugggcgaggcggccgccaucuucaugaccgccacgccgcccgggaccgcggaggccuucccccagagcaacgcccccauccaggacgaggagcgggacauccccgagcgcuccuggaacagcggcaacgaguggaucacggacuucguggggaagaccgugugguucguccccuccaucaaggccggcaacgacaucgccaacugccugcgcaagaacgggaagaaggugauccagcugagccggaagaccuucgacaccgaguaccagaagacgcgccucaacgacugggacuucguggucaccaccgacaucuccgagaugggcgcgaacuucaaggccgaccgggugaucgacccccgccggugccugaagcccgugauccugaccgacggccccgagcgcgucauccucgccgggccgaugcccgugacggccgccagcgcggcccagcggcgcggccggguggggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgcggccaucgacggcgaguaccgccugaagggcgagagccggaagaccuucgucgagcucaugcgccgcggggaccugcccguguggcuggcccacaaggucgccuccgagggcaucaaguacacggaccgcaaguggugcuucgacggggagcggaacaaccagauccucgaggagaacauggacguggagaucuggaccaaggagggcgagcgcaagaagcugcggccgcgcuggcuggacgcgcgcaccuacagcgacccccucgcccugaaggaguucaaggacuucgccgccggccggaaguccaucgcccuggaccucgugaccgagaucgggcgcguccccagccaccuggcgcaccggacgcgcaacgcccuggacaaccucgugaugcugcacaccuccgagcacggcgggcgggccuaccgccacgccguggaggagcugccggagaccauggagacccuccugcugcucggccugaugauccugcucaccggcggggccaugcuguuccugaucagcgggaaggggaucggcaagaccagcaucgggcucaucugcgucaucguguccagcggcaugcuguggauggcggacgugccccugcaguggaucgccuccgccaucguccucgaguucuucaugauggugcugcugauccccgagcccgagaagcagcggaccccgcaggacaaccagcucgccuacguggucaucgggauccugacccuggccgcgaucguggccgccaacgagaugggccuccuggagacgaccaagcgcgaccugggcaugagcaaggagcccgggguggucucccccaccagcuaccucgacguggaccugcaccccgccuccgccuggacccuguacgcgguggccacgaccgucaucaccccgaugcuccggcacaccaucgagaacagcacggccaacgugucccuggccgcgaucgccaaccaggccgugguccugaugggccucgacaagggguggcccaucagcaagauggaccugggcgugccccugcucgcccuggggugcuacucccaggugaacccccugacccucaccgccgcgguccugcugcucgugacccacuacgccaucaucggcccgggccugcaggccaaggccacgcgcgaggcccagaagcggaccgcggccgggaucaugaagaaccccaccguggacggcaucaugaccaucgaccuggaccccgucaucuacgacagcaaguucgagaagcagcucggccaggugaugcugcuggugcucugcgccguccagcugcugcucaugcgcacguccugggcccugugcgaggcccugacccucgcgaccggccccaucaccacgcugugggagggcagcccggggaaguucuggaacaccaccaucgccguguccauggccaacaucuuccggggcagcuaccuggccggggcgggccucgccuucuccaucaugaaguccguggggaccggccgccggggcacggggucccagggcgagacccugggggagaaguggaagaagaagcugaaccagcucagccgcaaggaguucgaccuguacaagaaguccggcaucaccgaggucgaccggaccgaggccaaggaggggcugaagcgcggcgagaccacgcaccacgccgugucccggggcagcgccaagcuccagugguucguggagcgcaacauggucauccccgaggggcgggugaucgaccugggcugcgggcgcggcgggugguccuacuacugcgcgggccugaagaaggugaccgagguccgcggcuacaccaagggcggccccgggcacgaggagcccgugccgaugagcaccuacggcuggaacaucgugaagcucauguccgggaaggacgucuucuaccugccgcccgagaagugcgacacgcugcugugcgacaucggcgagagcucccccagcccgaccguggaggagucccggaccauccgcgugcucaagauggucgagcccuggcugcggaacaaccaguucugcaucaaggugcugaaccccuacaugcccaacgugaucgagcaccucgagcgccugcagcggaaguacggcgggaugcugguccgcaacccgcucagccggaacuccacccacgagauguacuggaucagcaacggcacggggaacaucguguccagcgugaacauggucucccgccugcugcucaaccgguucaccaugacccaccgccggcccaccaucgagaaggacguggaccugggcgccggcacgcgccacgucaacgccgagcccgagaccccgaacauggacgugaucggggagcggaucaagcgcaucaaggaggagcacagcuccaccuggcacuacgacgacgagaaccccuacaagaccugggccuaccacggcagcuacgaggugaaggccacgggguccgcgagcagcaugaucaacggcgucgugaagcugcucaccaagcccugggacgugguccccauggugacccagauggccaugaccgacacgaccccguucgggcagcagcggguguucaaggagaaggucgacacccgcacgccccggcccaugcccggcacgcgcaaggugauggagaucaccgccgaguggcuguggcggacccugggccgcaacaagaagccgcgccucugcacccgggaggaguucacgaagaaggugcgcaccaacgccgccaugggggcggucuucaccgaggagaaccagugggacuccgcccgggccgccguggaggacgaggaguucuggaagcugguggacaaggagcgcgagcugcacaagcucggcaagugcgggagcugcgucuacaacaugaugggcaagcgggagaagaagcugggggaguucggcaaggcgaagggcucccgcgccaucugguacauguggcugggggcccgguaccucgaguucgaggcccugggcuuccugaacgaggaccacugguucagccgcgagaacuccuacagcgggguggagggcgaggggcuccacaagcugggcuacauccugcgggacaucuccaagauccccggcggggccauguacgcggacgacaccgccggcugggacacgcgcaucaccgaggacgaccuccacaacgaggagaagaucacccagcagauggaccccgagcaccggcagcuggccaacgccaucuucaagcugaccuaccagaacaagguggucaaggugcagcgccccacgccgaaggggaccgugauggacaucaucagccggaaggaccagcgcggcuccggccaggucgggaccuacggccucaacaccuucaccaacauggaggcccagcuggugcggcagauggagggggagggcgugcugagcgaggcggaccucgagaacccccaccuccuggagaagaagaucacgcaguggcucgagaccaagggggucgagcgccugaagcggauggccaucuccggcgacgacugcguggugaagcccaucgacgaccgcuucgccaacgcccugcucgcccugaacgacaugggcaagguccggaaggacaucccccaguggcagccgagcaagggguggcacgacuggcagcagguccccuucugcucccaccacuuccacgagcugaucaugaaggacggccgcaagcucgugguccccugccggccccaggacgagcugaucgggcgcgcgcgcaucagccagggcgccggguggucccugaaggagaccgccugccucggcaaggccuacgcccagauguggagccugauguacuuccaccggcgcgaccugcggcucgcguccaacgccaucugcagcgccgugccggugcacuggauccccaccucccgcacgaccuggagcauccacgcccaccaccaguggaugaccaccgaggacaugcugacggucuggaaccggguguggaucgaggacaaccccuggauggaggacaagacccccgugaccaccugggaggacgucccguaccugggcaagcgcgaggaccaguggugcgggagccucaucggccugacgucccgggcgaccugggcccagaacauccugaccgccauccagcagguccgcagccucaucggggacgaggaguuccuggacuacaugcccuccaugaagcgguuccgcaaggaggaggagagcgagggcgccaucugguga

SEQ ID NO: 9957 - RNA, 9873 nt, Artificial Sequence
  derived and/or modified CDS sequence (opt1) from DENV-3__KF955461__SS-prME
accagccugugccucaugaugaugcugcccgcgacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgucaccuacaagugcccccugaucgccgagguggagcccgaggacaucgacugcuggugcaaccucaccagcaccugggugaccuacgggaccugcaaccaggccggcgagcaccggcgcgacaagcgguccgucgcccuggcgccccacgugggcauggggcuggacacccgcacccagaccuggaugagcgccgagggcgccuggcgccagguggagaaggucgagaccugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccacccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccagcaccguggaggccgugcugcccgaguacggcacccucgggcuggagugcuccccgcgcaccggccuggacuucaacgagaugauccuccugacgaugaagaacaaggcguggaugguccaccggcagugguucuucgaccugccccuccccuggaccagcggcgccaccaccgagacgcccaccuggaaccgcaaggagcugcuggugaccuucaagaacgcccacgccaagaagcaggagguggucgugcucgggucccaggagggcgccaugcacaccgcgcugacgggggccaccgagauccagaacagcggcgggaccuccaucuucgccggccaccugaagugccggcucaagauggacaagcuggagcugaagggcaugagcuacgccaugugccucaacaccuucgugcugaagaaggaggucuccgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggagagcaacaucgugaucggcaucggggacaaggcccucaagaucaacugguacaagaagggcuccagcaucgggaagauguucgaggcgaccgcccggggcgcccgccggauggccauccugggcgacaccgccugggacuucggguccgucggcggggugcugaacagccucggcaagauggugcaccaggucuucggguccgcguacaccgcccuguucagcggcguguccuggaucaugaagaucggcaucggggugcugcucacguggaucggccugaacagcaagaacaccuccaugagcuucuccugcaucgucaucgggaucaucacccuguaccucggcgccguggugcaggccgacauggggugcgucaucaacuggaagggcaaggagcugaagugcggcagcgggaucuucgugaccaacgaggugcacacguggaccgagcaguacaaguuccaggccgacucccccaagcgccuggcgaccgccaucgccggcgccugggagaacggggucugcggcauccgcagcaccacgcggauggagaaccuccuguggaagcagaucgccaacgagcugaacuacauccucugggagaacaacaucaagcugaccgugguggucggggacaucaucggcgugcuggagcagggcaagcgcacccucacgccccagccgauggagcugaaguacuccuggaagacgugggggaaggcgaagaucgugaccgccgagacccagaacagcuccuucaucaucgacggccccaacacccccgagugccccagcgccucccgggccuggaacgucugggagguggaggacuacggguucggcguguucacgaccaacaucuggcugaagcuccgcgaggucuacacccagagcugcgaccaccggcugaugagcgcggccaucaaggacgagcgcgccgugcacgccgacaugggcuacuggaucgagucccagaagaacgggagcuggaagcuggagaaggccuccuucaucgaggugaagaccugcaccuggcccaagagccacacgcucugguccaacggcguccuggagagcgacaugaucauccccaagucccuggcggggcccaucagccagcacaaccaccggccgggcuaccacacccagaccgccgggcccuggcaccucggcaagcuggagcuggacuucaacuacugcgagggcaccacgguggccaucaccgagaacugcgggacccgcggccccucccuccggaccacgaccgugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgcgggggugcuguucacguucguccuccugcuguccggccagaucaccuggcgcgacauggcccacacccucaucaugaucggcagcaacgccuccgaccggauggggaugggcgugaccuaccuggcccugaucgccacguucaagauccagcccuuccucgcgcugggguucuuccugcgcaagcucaccagccgggagaaccugcugcucggcgugggccuggccauggccaccacccugcagcuccccgaggacaucgagcagauggccaacgggaucgcgcugggccugaugacgcucaagcugaucacccaguucgagaccuaccagcuguggaccgcccucgucagccugacgugcuccaacaccaucuucacccugaccguggccuggcgcacggccacccucauccuggccggggucagccugcucccgcugugccaguccagcuccaugcggaagaccgacuggcugcccaugaccguggcggccaugggcgugccgccccucccgcuguucaucuucagccugaaggacacgcccaagcgccgcuccuggccccucaacgagggggucauggccgugggccuggugagcauccuggccuccagccuccugcggaacgacguccccauggccggcccgcugguggccggcgggcuccugaucgccugcuacgugaucaccgggaccuccgccgaccugaccgucgagaaggccgccgacgugacgugggaggaggaggcggagcagaccggggugagccacaaccucaugaucaccgucgacgacgacgggaccaugcgcaucaaggacgacgagaccgagaacauccugacggugcugcucaagaccgcccugcugaucguguccggcaucuuccccuacagcauccccgccacccuccuggucuggcacaccuggcagaagcagacgcagcgguccggcgugcugugggacgugcccagcccgcccgagacccagaaggccgagcucgaggagggggucuaccgcaucaagcagcagggcaucuucgggaagacccaggugggcguggggguccagaaggagggcguguuccacaccauguggcacgugacgcggggcgccguccugacccacaacgggaagcgccuggagcccaacugggcguccgugaagaaggaccucaucagcuacggcgggggcuggcggcuguccgcccaguggcagaagggggaggaggugcaggucaucgccguggagcccggcaagaacccgaagaacuuccagaccaugcccggcaucuuccagaccacgaccggggagaucggcgccaucgcgcuggacuucaagcccgggaccagcggcagcccgaucaucaaccgcgagggcaagguggucgggcuguacggcaacgggguggugaccaagaacggcggguacgucuccggcaucgcccagacgaacgccgagcccgacggccccacccccgagcucgaggaggagauguucaagaagcggaaccugaccaucauggaccugcacccggggagcggcaagacccgcaaguaccuccccgccaucgugcgggaggccaucaagcgccggcugcgcacgcugauccucgcgcccacccggguggucgccgccgagauggaggaggcccugaaggggcugcccauccgcuaccagaccaccgccacgaaguccgagcacaccggccgggagaucguggaccucaugugccacgcgaccuucaccaugcgccugcugagcccggugcggguccccaacuacaaccucgugaucauggacgaggcccacuucacggaccccgccuccaucgccgcccgcggguacaucagcacccgggugggcaugggcgaggcggccgccaucuucaugaccgccacgccgcccgggacggcggaggccuucccccaguccaacgcccccauccaggacgaggagcgcgacauccccgagcgcagcuggaacuccggcaacgaguggaucaccgacuucgucgggaagaccgugugguucgugcccagcaucaaggccggcaacgacaucgccaacugccugcggaagaacgggaagaaggucauccagcugucccgcaagaccuucgacacggaguaccagaagacccggcucaacgacugggacuucguggugaccaccgacaucagcgagaugggcgcgaacuucaaggccgaccgcgucaucgacccccggcgcugccugaagcccgugauccugacggacggccccgagcgggugauccucgccgggccgaugcccgucaccgccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagacguucgucgagcucaugcggcgcggggaccugcccguguggcuggcccacaagguggccagcgagggcaucaaguacaccgaccggaaguggugcuucgacggggagcgcaacaaccagauccucgaggagaacauggacgucgagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugacggagaucgggcgggugcccucccaccuggcgcaccgcacccggaacgcccuggacaaccucgucaugcugcacaccagcgagcacggcgggcgcgccuaccggcacgccguggaggagcugccggagaccauggagacgcuccugcugcucggccugaugauccugcucaccgggggcgccaugcuguuccugaucagcggcaaggggaucggcaagaccuccaucgggcucaucugcgugaucgucagcuccggcaugcuguggauggcggacgugccccugcaguggaucgccagcgccaucgugcucgaguucuucaugaugguccugcugauccccgagcccgagaagcagcgcaccccgcaggacaaccagcucgccuacguggugaucgggauccugacgcuggccgcgaucgucgccgccaacgagaugggccuccuggagaccaccaagcgggaccugggcauguccaaggagcccgggguggugagccccaccuccuaccucgacgucgaccugcaccccgccagcgccuggacgcuguacgcgguggccaccaccgugaucaccccgaugcuccgccacacgaucgagaacuccaccgccaacgucagccuggccgcgaucgccaaccaggccguggugcugaugggccucgacaagggguggcccaucuccaagauggaccugggcgucccccugcucgcccuggggugcuacagccaggugaacccccugacccucaccgccgcggugcugcugcucgucacgcacuacgccaucaucggcccgggccugcaggccaaggccacccgggaggcccagaagcgcaccgcggccgggaucaugaagaaccccaccguggacggcaucaugacgaucgaccuggaccccgugaucuacgacuccaaguucgagaagcagcucgggcaggucaugcugcuggugcucugcgccgugcagcugcugcucaugcggaccagcugggcccugugcgaggcccugacccucgcgaccggccccaucacgacccugugggagggcuccccggggaaguucuggaacaccaccaucgccgucagcauggccaacaucuuccgcggcuccuaccuggccggggcgggccucgccuucagcaucaugaaguccguggggacgggccggcgcggcaccgggagccagggcgagacccugggggagaaguggaagaagaagcugaaccagcucagccggaaggaguucgaccuguacaagaaguccggcaucaccgagguggaccgcaccgaggccaaggaggggcugaagcggggcgagacgacccaccacgccgucagccgcggcuccgccaagcuccagugguucguggagcggaacauggugauccccgaggggcgcgucaucgaccugggcugcgggcgcggcggguggagcuacuacugcgcgggccugaagaaggugaccgaggugcggggcuacaccaagggcggccccgggcacgaggagcccgucccgauguccacguacggcuggaacaucgugaagcucaugagcgggaaggacguguucuaccugccgcccgagaagugcgacacccugcugugcgacaucggcgaguccagccccuccccgaccgucgaggagagccgcaccauccgggugcucaagaugguggagcccuggcugaagaacaaccaguucugcaucaagguccugaaccccuacaugcccacggugaucgagcaccucgagcgccugcagcggaaguacggcgggaugcuggugcgcaacccgcucucccggaacagcacccacgagauguacuggaucuccaacggcaccgggaacaucgucagcuccgugaacauggucagccgccugcugcucaaccgguucaccaugacgcaccgccggcccaccaucgagaaggacguggaccugggcgccggcacccgccacgugaacgccgagcccgagaccccgaacauggacgucaucggggagcggaucaagcgcaucaaggaggagcacuccagcacguggcacuacgacgacgagaaccccuacaagaccugggccuaccacggcuccuacgaggugaaggccaccgggagcgcgagcuccaugaucaacggcguggucaagcugcucaccaagcccugggacguggugcccauggucacgcagauggccaugaccgacaccaccccguucgggcagcagcggguguucaaggagaagguggacacgcgcacgccccggcccaugcccggcacccgcaaggucauggagaucaccgccgaguggcuguggcggacgcugggccgcaacaagaagccgcgccucugcacccgggaggaguucaccaagaaggugcgcaccaacgccgccaugggggcgguguucacggaggagaaccagugggacagcgcccgggccgccgucgaggacgaggaguucuggaagcugguggaccgcgagcgggagcugcacaagcucggcaagugcggguccugcguguacaacaugaugggcaagcgcgagaagaagcugggggaguucggcaaggcgaagggcagccgggccaucugguacauguggcugggggcccgcuaccucgaguucgaggcccugggcuuccugaacgaggaccacugguucucccgggagaacagcuacuccggggucgagggcgaggggcuccacaagcugggcuacauccugcgcgacaucagcaagauccccggcggggccauguacgcggacgacaccgccggcugggacacccggaucaccgaggacgaccuccacaacgaggagaagaucacgcagcagauggaccccgagcaccgccagcuggccaacgccaucuucaagcugaccuaccagaacaagguggugaagguccagcggcccaccccgaaggggaccgugauggacaucaucucccgcaaggaccagcggggcagcggccagguggggaccuacggccucaacacguucaccaacauggaggcccagcugguccgccagauggagggggagggcgugcuguccaaggcggaccucgagaacccccaccagcuggagaagaagaucacccaguggcuggagaccaaggggguggagcggcucaagcgcauggccaucagcggcgacgacugcgucgugaagcccaucgacgaccgguucgccaacgcccugcuggcccucaacgacaugggcaaggugcgcaaggacaucccccaguggcagccguccaagggguggcacgacuggcagcagguccccuucugcagccaccacuuccacgagcugaucaugaaggacggccggaagcugguggugcccugccgcccccaggacgagcucaucgggcgcgcgcggaucucccagggcgccggguggagccugaaggagacggccugccugggcaaggccuacgcccagauguggucccucauguacuuccaccgccgggaccugcgccuggcgagcaacgccaucugcuccgccgucccggugcacuggauccccaccagccggaccaccuggagcauccacgcccaccaccaguggaugacgaccgaggacaugcucaccguguggaaccgcgucuggaucgaggacaaccccuggauggaggacaagacccccgugacgaccugggaggacgugccguaccugggcaagcgggaggaccaguggugcgggucccugaucggccucaccagccgcgcgaccugggcccagaacauccugacggccauccagcagguccggucccugaucggggacgaggaguuccucgacuacaugcccagcaugaagcgcuuccggaaggaggaggaguccgagggcgccaucugguga

SEQ ID NO: 9958 - RNA, 9873 nt, Artificial Sequence
  derived and/or modified CDS sequence (opt1) from DENV-3__FJ639719__SS-prME
accagccugugccucaugaugaugcugcccgccacccuggccuuccaccucaccagccgggacggggagccccggaugaucguggggaagaacgagcgcggcaagagccugcuguucaagaccgcgaccgggaucaacaugugcacccucaucgccauggaccugggcgagaugugcgacgacaccgugaccuacaagugcccccugaucgccgagguggagcccgaggacaucgacugcuggugcaaccucaccuccaccugggugacguacgggaccugcaaccaggccggcgagcaccggcgcgacaagcggagcgucgcccuggcgccccacgugggcauggggcuggacacccgcacccagacguggauguccgccgagggcgccuggcgccagguggagaaggucgagaccugggcccuccgccacccgggguucaccauccuggcgcuguuccucgcccacuacaucggcaccagccugauccagaagguggugaucuucauccugcucaugcuggucacgcccuccaugaccaugcggugcgugggggugggcaaccgcgacuucgucgagggccugagcggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacucccgcugccccacgcagggcgaggccauccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccuccaccguggaggccgugcugcccgaguacggcacccucgggcuggagugcagcccgcgcaccggccuggacuucaacgagaugauccuccugaccaugaagaacaaggcguggaugguccaccggcagugguucuucgaccugccccuccccuggacguccggcgccaccaccgagacccccacguggaaccgcaaggagcugcuggugaccuucaagaacgcccacgccaagaagcaggagguggucgugcucgggagccaggagggcgccaugcacaccgcgcugaccggggccacggagauccagaacuccggcgggaccagcaucuucgccggccaccugaagugccggcucaagauggacaagcuggagcugaagggcauguccuacgccaugugccucaacaccuucgugcugaagaaggaggucagcgagacccagcacgggacgauccugaucaagguggaguacaagggcgaggacgccccgugcaagauccccuucuccaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcagcuccaucgggaagauguucgaggcgacggcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucaccuggaucggccugaacuccaagaacacgagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacaccuggacggagcaguacaaguuccaggccgacagccccaagcgccuggcgaccgccaucgccggcgccugggagaacggggugugcggcauccgcuccaccacccggauggagaaccuccuguggaagcagaucgccaacgagcugaacuacauccucugggagaacaacaucaagcugacggucguggugggggacaucaucggcguccuggagcagggcaagcgcacccucacgccccagccgauggagcugaaguacagcuggaagaccugggggaaggcgaagaucgugacggccgagacccagaacuccagcuucaucaucgacggccccaacacccccgagugccccuccgccagccgggccuggaacgugugggaggucgaggacuacggguucggcguguucaccacgaacaucuggcugaagcuccgcgagguguacacccaguccugcgaccaccggcugaugagcgcggccaucaaggacgagcgcgccguccacgccgacaugggcuacuggaucgagagccagaagaacggguccuggaagcuggagaaggccagcuucaucgaggugaagaccugcaccuggccgaagucccacacccucuggagcaacggcgugcuggaguccgacaugaucauccccaagagccuggcggggcccaucucccagcacaaccaccggccgggcuaccacacgcagaccgccgggcccuggcaccucggcaagcuggagcuggacuucaacuacugcgagggcaccaccgucgugaucacggagaacugcgggacccgcggccccagccuccggaccaccacgguguccgggaagcugauccacgaguggugcugccgcagcugcacccugcccccgcuccgguacaugggcgaggacgggugcugguacggcauggagauccgccccaucaacgagaaggaggagaacauggucaagucccuggugagcgccggcuccgggaagguggacaacuucaccaugggcguccugugccucgccauccuguucgaggaggugaugcgggggaaguucggcaagaagcacaugaucgccggggugcuguucaccuucguccuccugcugagcggccagaucacguggcgcgacauggcgcacacccucaucaugaucggcuccaacgccagcgaccggauggggaugggcgugacccaccuggcccugaucgccaccuucaagauccagcccuuccucgcccugggguucuuccugcgcaagcucacgucccgggagaaccugcugcucggcgugggccuggcgauggccaccacccugcagcuccccgaggacaucgagcagauggccaacgggaucgcccugggccugaugacccucaagcugaucacgcaguucgagaccuaccagcuguggaccgcgcucgucagccugaccugcagcaacacgaucuucacccugaccguggccuggcgcaccgccacgcucauccuggccggggucucccugcucccgcugugccagagcuccagcaugcggaagaccgacuggcugcccaugaccguggccgcgaugggcgugccgccccugccgcuguucaucuucucccugaaggacacccccaagcgccgcagcuggccccucaacgagggggucauggccgugggccugguguccauccuggccagcucccuccugcggaacgacguccccauggccggcccgcugguggccgggggccuccugaucgcgugcuacgugaucacggggaccagcgccgaccugaccgucgagaaggccgccgacgugaccugggaggaggaggccgagcagacgggcgugucccacaaccucaugaucaccgucgacgacgacgggaccaugcgcaucaaggacgacgagaccgagaacauccugaccgugcugcucaagacggcgcugcugaucgugagcggcaucuuccccuacuccauccccgccacccuccuggucuggcacaccuggcagaagcagacccagcggagcggcgugcugugggacgugcccuccccgcccgagacgcagaaggccgagcucgaggagggggucuaccgcaucaagcagcagggcaucuucgggaagacccaggugggcguggggguccagaaggagggcguguuccacaccauguggcacgugacccggggcgccguccugacgcacaacgggaagcgccuggagcccaacugggccagcgugaagaaggaccucaucuccuacggcgggggcuggcggcugagcacccaguggcagaagggggaggaggugcaggucaucgcgguggagcccggcaagaacccgaagaacuuccagaccaugcccggcaucuuccagaccacgaccggggagaucggcgccaucgcccuggacuucaagcccgggaccuccggcagcccgaucaucaaccgcgagggcaagguggucgggcuguacggcaacgggguggugaccaagaacggcggguacgucagcggcaucgcccagacgaacgcggagcccgacggccccacccccgagcucgaggaggagauguucaagaagcggaaccugaccaucauggaccugcacccgggguccggcaagacccgcaaguaccuccccgccaucgugcgggaggccaucaagcgccggcugcgcacgcugauccucgcccccacccggguggucgccgcggagauggaggaggcccugaaggggcugcccauccgcuaccagaccaccgccaccaagagcgagcacaccggccgggagaucguggaccucaugugccacgccaccuucaccaugcgccugcuguccccggugcggguccccaacuacaaccucaucaucauggacgaggcccacuucacggaccccgcgagcaucgccgcccgcggguacaucuccacccgggugggcaugggcgaggccgccgcgaucuucaugaccgccacgccgcccgggacggccgaggccuucccccagagcaacgcgcccauccaggacgaggagcgcgacauccccgagcgcuccuggaacagcggcaacgaguggaucaccgacuucguggggaagaccgucugguucgugcccuccaucaaggccggcaacgacaucgccaacugccugcggaagaacgggaagaaggugauccagcugagccgcaagaccuucgacacggaguaccagaagacccggcucaacgacugggacuucgucgugaccaccgacaucuccgagaugggcgccaacuucaaggccgaccgcgugaucgacccccggcgcugccugaagcccgucauccugacggacggccccgagcgggugauccucgcggggccgaugcccgugaccgccgccagcgccgcccagcgccggggccgcgucgggcggaacccccagaaggagaacgaccaguacaucuucaccggccagccccugaacaacgacgaggaccacgcgcacuggaccgaggccaagaugcugcucgacaacaucaacaccccggaggggaucauccccgcccuguucgagcccgagcgcgagaaguccgccgccaucgacggcgaguaccggcugaagggcgagagccgcaagacguucguggagcucaugcggcgcggggaccugcccgucuggcuggcgcacaagguggccuccgagggcaucaaguacaccgaccggaaguggugcuucgacggggagcgcaacaaccagauccucgaggagaacauggacguggagaucuggaccaaggagggcgagcggaagaagcugcgcccgcgcuggcuggacgcccggaccuacagcgacccccucgcccugaaggaguucaaggacuucgcggccggccgcaaguccaucgcccuggaccucgucacggagaucgggcgggugcccagccaccuggcccaccgcacccggaacgcccuggacaaccucgugaugcugcacaccuccgagcacggcgggcgcgcguaccggcacgccgucgaggagcugccggagaccauggagacgcuccugcugcucggccugaugauccugcucaccgggggcgccaugcuguuccuggugagcggcaaggggaucggcaagaccaccaucgggcucaucugcgugaucgucagcuccggcaugcuguggauggccgacaucccccugcaguggaucgccagcgcgaucgugcucgaguucuucaugauggugcugcugauccccgagcccgagaagcagcgcacgccgcaggacaaccagcucgccuacgucgugaucgggauccugacccuggccgccaucguggccgcgaacgagaugggccuccuggagaccaccaagcgggaccugggcauguccaaggagcccggggucgugagccccacguccuaccucgacguggaccugcaccccgccagcgccuggacccuguacgccgucgccaccaccgugaucacgccgaugcuccgccacaccaucgagaacuccaccgcgaacgugagccuggccgccaucgccaaccaggcggucgugcugaugggccucgacaagggguggcccaucuccaagauggaccugggcgugccccugcucgcccuggggugcuacagccaggucaacccccugacccucacggccgccgugcugcugcucgugacccacuacgccaucaucggcccgggccugcaggcgaaggccacccgggaggcccagaagcgcaccgccgccgggaucaugaagaaccccacggucgacggcaucaugaccaucgaccuggaccccgugaucuacgacuccaaguucgagaagcagcucggccaggugaugcugcugguccucugcgcggugcagcugcugcucaugcggaccagcugggcccugugcgaggcccugacccucgccacgggccccaucaccacccugugggagggcuccccggggaaguucuggaacaccacgaucgccgugagcauggcgaacaucuuccgcggcuccuaccuggccggggccggccucgccuucagcaucaugaaguccgucgggaccggccggcgcggcaccgggagccagggcgagacccugggggagaaguggaagaagaagcugaaccagcucucccggaaggaguucgaccuguacaagaaguccggcaucaccgagguggaccgcacggaggcgaaggaggggcugaagcggggcgagaccacccaccacgccgugagccgcggcuccgccaagcuccagugguucgucgagcggaacauggugauccccgaggggcgcgugaucgaccugggcugcgggcgcggcggguggagcuacuacugcgccggccugaagaaggucaccgaggugcggggcuacacgaagggcgggcccgggcacgaggagcccgugccgauguccaccuacggcuggaacaucgucaagcucaugagcgggaaggacguguucuaccugccgcccgagaagugcgacacccugcugugcgacaucggcgaguccagccccuccccgaccguggaggagagccgcacgauccggguccucaagaugguggagcccuggcugaagaacaaccaguucugcaucaaggugcugaaccccuacaugcccaccgucaucgagcaccucgagcgccugcagcggaaguacggcgggaugcuggugcgcaacccgcucucccggaacagcacccacgagauguacuggaucuccaacggcaccgggaacaucgugagcuccgucaacauggugagccgccugcugcucaaccgguucacgaugacccaccgccggcccaccaucgagaaggacgucgaccugggcgccggcacccgccacgugaacgcggagcccgagacgccgaacauggacgugaucggggagcggaucaagcgcaucaaggaggagcacuccagcaccuggcacuacgacgacgagaaccccuacaagaccugggccuaccacggcuccuacgaggucaaggccaccgggagcgccuccagcaugaucaacggcguggugaagcugcucacgaagcccugggacgucgugcccauggugacccagauggccaugaccgacaccacgccguucgggcagcagcgggucuucaaggagaagguggacacccgcacgccccggcccaugcccggcacccgcaaggugauggagaucacggcggaguggcuguggcggacccugggccgcaacaagaagccgcgccucugcacccgggaggaguucaccaagaagguccgcacgaacgccgccaugggggccguguucaccgaggagaaccagugggacagcgcccgggcggccguggaggacgaggaguucuggaagcuggucgaccgcgagcgggagcugcacaagcucggcaagugcggguccugcguguacaacaugaugggcaagcgcgagaagaagcugggggaguucggcaaggccaagggcagccgggccaucugguacauguggcugggggcgcgcuuccucgaguucgaggcccugggcuuccugaacgaggaccacugguucucccgggagaacagcuacuccgggguggagggcgaggggcuccacaagcugggcuacauccugcgcgacaucagcaagauccccggcggggccauguacgccgacgacaccgccggcugggacacccggaucacggaggacgaccuccacaacgaggagaagaucacccagcagauggaccccgagcaccgccagcuggcgaacgccaucuucaagcugaccuaccagaacaaggucgugaaggugcagcggcccaccccgaaggggaccgucauggacaucaucucccgcaaggaccagcggggcagcggccagguggggacguacggccucaacaccuucaccaacauggaggcccagcuggugcgccagauggagggggagggcguccuguccaaggccgaccucgagaacccccaccuccuggagaagaagaucacccaguggcucgagaacaaggggguggagcggcugaagcgcauggccaucagcggcgacgacugcguggucaagcccaucgacgaccgguucgcgaacgcccugcucgcccugaacgacaugggcaaggugcgcaaggacaucccccaguggcagccguccaagggguggcacgacuggcagcagguccccuucugcagccaccacuuccacgagcugaucaugaaggacggccggaagcucgucgugcccugccgcccccaggacgagcugaucgggcgcgcccggaucucccagggcgccggguggagccugaaggagacggcgugccucggcaaggccuacgcccagauguggucccugauguacuuccaccgccgggaccugcgccucgccagcaacgccaucugcuccgcggugccgguccacugggugcccaccagccggaccaccugguccauccacgcccaccaccaguggaugacgaccgaggacaugcugaccguguggaaccgcgucuggaucgaggacaaccccuggauggaggacaagacccccgugacgaccugggaggacgugccguaccugggcaagcgggaggaccaguggugcgggagccucaucggccugaccagccgcgccaccugggcccagaacauccugacggcgauccagcagguccggucccucaucggggacgaggaguuccuggacuacaugcccagcaugaagcgcuuccggaaggaggaggaguccgagggcgccaucugguga

SEQ ID NO: 9959 - RNA, 9873 nt, Artificial Sequence
  derived and/or modified CDS sequence (opt1) from DENV-3__KF955332__SS-prME
accagccugugccucaugaugaugcugcccgcgacccuggccuuccaccucaccagccgggacggcgagccccggaugaucguggggaagaacgagcgcggcaagagccugcuguucaagaccgcgaccgggaucaacaugugcacccucaucgccauggaccugggcgagaugugcgacgacacggugaccuacaagugcccccugaucgccgagguggagcccgaggacaucgacugcuggugcaaccucaccuccaccugggugacguacgggaccugcaaccaggccggcgagcaccggcgcgacaagcggagcgucgcccuggcgccccacgugggcauggggcuggacacccgcacccagacguggauguccgccgagggcgccuggcgccagguggagaaggucgagaccugggcccuccgccacccgggguucaccauccuggcgcuguuccucgcccacuacaucggcaccagccugauccagaagguggugaucuucauccugcucaugcuggucacgcccuccaugaccaugcggugcgugggggugggcaaccgcgacuucgucgagggccugagcggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacucccgcugccccacgcagggcgaggccauccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccuccaccguggaggccgugcugcccgaguacggcacccucgggcuggagugcagcccgcgcaccggccuggacuucaacgagaugauccuccugaccaugaagaacaaggcguggaugguccaccggcagugguucuucgaccugccccuccccuggacguccggcgccaccaccgagacccccacguggaaccgcaaggagcugcuggugaccuucaagaacgcccacgccaagaagcaggagguggucgugcucgggagccaggagggcgccaugcacaccgcgcugaccggggccacggagauccagaacuccggcgggaccagcaucuucgccggccaccugaagugccggcucaagauggacaagcuggagcugaagggcauguccuacgccaugugccucaacaccuucgugcugaagaaggaggucagcgagacccagcacgggacgauccugaucaagguggaguacaagggcgaggacgccccgugcaagauccccuucuccaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcagcuccaucgggaagauguucgaggcgacggcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucaccuggaucggccugaacuccaagaacacgagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacaccuggacggagcaguacaaguuccaggccgacagccccaagcgccuggcgaccgccaucgccggcgccugggagaacggggugugcggcauccgcuccaccacccggauggagaaccuccuguggaagcagaucgccaacgagcugaacuacauccucugggagaacaacaucaagcugacggucguggugggggacaucaucggcguccuggagcagggcaagcgcacccucacgccccagccgauggagcugaaguacagcuggaagaccugggggaaggcgaagaucgugacggccgagacccagaacuccagcuucaucaucgacggccccaacacccccgagugccccuccgccagccgggccuggaacgugugggaggucgaggacuacggguucggcguguucaccacgaacaucuggcugaagcuccgcgagguguacacccaguccugcgaccaccggcugaugagcgcggccaucaaggacgagcgcgccguccacgccgacaugggcuacuggaucgagagccagaagaacggguccuggaagcuggagaaggccagcuucaucgaggugaagaccugcaccuggccgaagucccacacccucuggagcaacggcgugcuggaguccgacaugaucauccccaagagccuggcggggcccaucucccagcacaaccaccggccgggcuaccacacgcagaccgccgggcccuggcaccucggcaagcuggagcuggacuucaacuacugcgagggcaccaccgucgugaucacggagaacugcgggacccgcggccccagccuccggaccaccacgguguccgggaagcugauccacgaguggugcugccgcagcugcacccugcccccgcuccgguacaugggcgaggacgggugcugguacggcauggagauccgccccaucaacgagaaggaggagaacauggucaagucccuggugagcgccggcuccgggaagguggacaacuucaccaugggcguccugugccucgccauccuguucgaggaggugaugcgggggaaguucggcaagaagcacaugaucgccggggugcuguucaccuucguccuccugcugagcggccagaucacguggcgcgacauggcgcacacccucaucaugaucggcuccaacgccagcgaccggauggggaugggcgugaccuaccuggcccugaucgccaccuucaagauccagcccuuccucgcccugggguucuuccugcgcaagcucacgucccgggagaaccugcugcucggcgugggccuggcgauggccaccacccugcagcuccccgaggacaucgagcagauggccaacgggaucgcccugggccugaugacccucaagcugaucacgcaguucgagaccuaccagcuguggaccgcgcucgucagccugaccugcagcaacacgaucuucacccugaccguggccuggcgcaccgccacgcucauccuggccggggucucccugcucccgcugugccagagcuccagcaugcggaagaccgacuggcugcccaugaccguggccgcgaugggcgugccgccccugccgcuguucaucuucucccugaaggacgcccccaagcgccgcagcuggccccucaacgagggggucauggccgugggccugguguccauccuggccagcucccuccugcggaacgacguccccauggccggcccgcugguggccggcgggcuccugaucgccugcuacgugaucaccgggacgagcgccgaccugaccgucgagaaggccgccgacgugaccugggaggaggaggcggagcagaccggggugucccacaaccucaugaucacggucgacgacgacgggaccaugcgcaucaaggacgacgagaccgagaacauccugaccgugcugcucaagaccgcccugcugaucgugagcggcaucuuccccuacuccauccccgccacgcuccuggucuggcacaccuggcagaagcagacccagcggagcggcgugcugugggacgugcccuccccgcccgagacccagaaggccgagcucgaggagggggucuaccgcaucaagcagcagggcaucuucgggaagacccaggugggcguggggguccagaaggagggcguguuccacaccauguggcacgugacccggggcgccguccugacccacaacgggaagcgccuggagcccaacugggcgagcgugaagaaggaccucaucuccuacggcgggggcuggcggcugagcacgcaguggcagaagggggaggaggugcaggucaucgccguggagcccggcaagaacccgaagaacuuccagaccaugcccggcaucuuccagaccaccacgggggagaucggcgccaucgcccuggacuucaagcccgggaccuccggcagcccgaucaucaaccgcgagggcaagguggucgggcuguacggcaacgggguggugaccaagaacggcggguacgucagcggcaucgcgcagaccaacgccgagcccgacggccccacgcccgagcucgaggaggagauguucaagaagcggaaccugaccaucauggaccugcacccgggguccggcaagacccgcaaguaccuccccgccaucgugcgggaggccaucaagcgccggcugcgcacccugauccucgcccccacgcggguggucgcggccgagauggaggaggcccugaaggggcugcccauccgcuaccagaccaccgccaccaagagcgagcacacgggccgggagaucguggaccucaugugccacgccaccuucaccaugcgccugcuguccccggugcggguccccaacuacaaccucaucaucauggacgaggcgcacuucaccgaccccgccagcaucgccgcccgcggguacaucuccacgcgggugggcaugggcgaggccgcggccaucuucaugaccgccacgccgcccgggaccgccgaggcguucccccagagcaacgcccccauccaggacgaggagcgcgacauccccgagcgcuccuggaacagcggcaacgaguggaucacggacuucguggggaagaccgucugguucgugcccuccaucaaggccggcaacgacaucgccaacugccugcggaagaacgggaagaaggugauccagcugagccgcaagaccuucgacaccgaguaccagaagacgcggcucaacgacugggacuucgucgugaccaccgacaucuccgagaugggcgccaacuucaaggcggaccgcgugaucgacccccggcgcugccugaagcccgucauccugaccgacggccccgagcgggugauccucgccgggccgaugcccgugacggccgccagcgccgcgcagcgccggggccgcgucgggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgccgcgaucgacggcgaguaccggcugaagggcgagagccgcaagaccuucguggagcucaugcggcgcggggaccugcccgucuggcuggcccacaagguggccuccgagggcaucaaguacacggaccggaaguggugcuucgacggggagcgcaacaaccagauccucgaggagaacauggacguggagaucuggaccaaggagggcgagcggaagaagcugcgcccgcgcuggcuggacgcccggaccuacagcgacccccucgcgcugaaggaguucaaggacuucgccgccggccgcaaguccaucgcccuggaccucgucaccgagaucgggcgggugcccagccaccuggcccaccgcacgcggaacgcgcuggacaaccucgugaugcugcacaccuccgagcacggcgggcgcgccuaccggcacgccgucgaggagcugccggagaccauggagacccuccugcugcucggccugaugauccugcucaccggcggggccaugcuguuccuggugagcgggaaggggaucggcaagaccaccaucgggcucaucugcgugaucgucagcuccggcaugcuguggauggccgacaucccccugcaguggaucgcgagcgccaucgugcucgaguucuucaugauggugcugcugauccccgagcccgagaagcagcgcaccccgcaggacaaccagcucgccuacgucgugaucgggauccugacgcuggccgccaucguggcggccaacgagaugggccuccuggagaccaccaagcgggaccugggcauguccaaggagcccggggucgugagccccaccuccuaccucgacguggaccugcaccccgccagcgccuggacgcuguacgccgucgcgaccaccgugaucaccccgaugcuccgccacacgaucgagaacuccaccgccaacgugagccuggccgccaucgcgaaccaggccgucgugcugaugggccucgacaagggguggcccaucuccaagauggaccugggcgugccccugcucgcccuggggugcuacagccaggucaacccccugacccucaccgccgccgugcugcugcucgugacgcacuacgcgaucaucggcccgggccugcaggccaaggccacccgggaggcccagaagcgcaccgccgcggggaucaugaagaaccccaccgucgacggcaucaugacgaucgaccuggaccccgugaucuacgacuccaaguucgagaagcagcucggccaggugaugcugcugguccucugcgccgugcagcugcugcucaugcggaccagcugggcccugugcgaggcccugacccucgccaccggccccaucacgacccugugggagggcuccccggggaaguucuggaacaccaccaucgcggugagcauggccaacaucuuccgcggcuccuaccuggccggggccggccucgcguucagcaucaugaaguccgucgggacgggccggcgcggcaccgggagccagggcgagacccugggggagaaguggaagaagaagcugaaccagcucucccggaaggaguucgaccuguacaagaaguccggcaucaccgagguggaccgcaccgaggccaaggaggggcugaagcggggcgagacgacccaccacgccgugagccgcggcuccgccaagcuccagugguucgucgagcggaacauggugauccccgaggggcgcgugaucgaccugggcugcgggcgcggcggguggagcuacuacugcgccggccugaagaaggucaccgaggugcggggcuacaccaagggcggccccgggcacgaggagcccgugccgauguccacguacggcuggaacaucgucaagcucaugagcgggaaggacguguucuaccugccgcccgagaagugcgacacccugcugugcgacaucggcgaguccagccccuccccgaccguggaggagagccgcaccauccggguccucaagaugguggagcccuggcugaagaacaaccaguucugcaucaaggugcugaaccccuacaugcccacggucaucgagcaccucgagcgccugcagcggaaguacggcgggaugcuggugcgcaacccgcucucccggaacagcacccacgagauguacuggaucuccaacggcaccgggaacaucgugagcuccgucaacauggugagccgccugcugcucaaccgguucaccaugacgcaccgccggcccaccaucgagaaggacgucgaccugggcgcgggcacccgccacgugaacgccgagcccgagaccccgaacauggacgugaucggggagcggaucaagcgcaucaaggaggagcacuccagcacguggcacuacgacgacgagaaccccuacaagaccugggccuaccacggcuccuacgaggucaaggccaccgggagcgccuccagcaugaucaacggcguggugaagcugcucaccaagcccugggacgucgugcccauggugacgcagauggcgaugaccgacaccaccccguucgggcagcagcgggucuucaaggagaagguggacacgcgcacgccccggcccaugcccggcacccgcaaggugauggagaucaccgccgaguggcuguggcggacgcugggccgcaacaagaagccgcgccucugcacccgggaggaguucaccaagaagguccgcaccaacgccgccaugggggccguguucacggaggagaaccagugggacagcgcgcgggccgccguggaggacgaggaguucuggaagcuggucgaccgcgagcgggagcugcacaagcucggcaagugcggguccugcguguacaacaugaugggcaagcgcgagaagaagcugggggaguucggcaaggccaagggcagccgggcgaucugguacauguggcugggggcccgcuuccucgaguucgaggcccugggcuuccugaacgaggaccacugguucucccgggagaacagcuacuccgggguggagggcgaggggcuccacaagcugggcuacauccugcgcgacaucagcaagauccccggcggggccauguacgccgacgacaccgcgggcugggacacccggaucaccgaggacgaccuccacaacgaggagaagaucacgcagcagauggaccccgagcaccgccagcuggccaacgccaucuucaagcugaccuaccagaacaaggucgugaaggugcagcggcccaccccgaaggggaccgucauggacaucaucucccgcaaggaccagcggggcagcggccagguggggaccuacggccucaacacguucaccaacauggaggcccagcuggugcgccagauggagggggagggcguccuguccaagaccgaccucgagaacccccaccuccuggagaagaagaucacccaguggcucgagaacaaggggguggagcggcugaagcgcauggccaucagcggcgacgacugcguggucaagcccaucgacgaccgguucgcgaacgcccugcucgcccugaacgacaugggcaaggugcgcaaggacaucccccaguggcagccguccaagggguggcacgacuggcagcagguccccuucugcagccaccacuuccacgagcugaucaugaaggacggccggaagcucgucgugcccugccgcccccaggacgagcugaucgggcgcgcccggaucucccagggcgccggguggagccugaaggagacggcgugccucggcaaggccuacgcccagauguggucccugauguacuuccaccgccgggaccugcgccucgccagcaacgccaucugcuccgcggugccgguccacugggugcccaccagccggaccaccugguccauccacgcccaccaccaguggaugacgaccgaggacaugcugaccguguggaaccgcgucuggaucgaggacaaccccuggauggaggacaagacccccgugacgaccugggaggacgugccguaccugggcaagcgggaggaccaguggugcgggagccucaucggccugaccagccgcgccaccugggcccagaacauccugacggcgauccagcagguccggucccucaucggggacgaggaguuccuggacuacaugcccagcaugaagcgcuuccggaaggaggaggaguccgagggcgccaucugguga

SEQ ID NO: 9960 - RNA, 9873 nt, Artificial Sequence
  derived and/or modified CDS sequence (opt1) from DENV-3__FJ639720__SS-prME
accagccucugccucaugaugaugcuccccgccacccuggccuuccaccucaccagccgggacggggagccccggaugaucguggggaagaacgagcgcggcaagagccugcuguucaagaccgcgaccgggaucaacaugugcacccucaucgccauggaccugggcgagaugugcgacgacaccgugaccuacaagugcccccugaucgccgagguggagcccgaggacaucgacugcuggugcaaccucaccuccaccugggugacguacgggaccugcaaccaggccggcgagcaccggcgcgacaagcggagcgucgcccuggcgccccacgugggcauggggcuggacacccgcacccagacguggauguccgccgagggcgccuggcgccagguggagaaggucgagaccugggcccuccgccacccgggguucaccauccuggcgcuguuccucgcccacuacaucggcaccagccugauccagaagguggugaucuucauccugcucaugcuggucacgcccuccaugaccaugcggugcgugggggugggcaaccgcgacuucgucgagggccugagcggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacucccgcugccccacgcagggcgaggccauccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccuccaccguggaggccgugcugcccgaguacggcacccucgggcuggagugcagcccgcgcaccggccuggacuucaacgagaugauccuccugaccaugaagaacaaggcguggaugguccaccggcagugguucuucgaccugccccuccccuggacguccggcgccaccaccgagacccccacguggaaccgcaaggagcugcuggugaccuucaagaacgcccacgccaagaagcaggagguggucgugcucgggagccaggagggcgccaugcacaccgcgcugaccggggccacggagauccagaacuccggcgggaccagcaucuucgccggccaccugaagugccggcucaagauggacaagcuggagcugaagggcauguccuacgccaugugccucaacaccuucgugcugaagaaggaggucagcgagacccagcacgggacgauccugaucaagguggaguacaagggcgaggacgccccgugcaagauccccuucuccaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccuccggaucaacugguacaagaagggcagcuccaucgggaagauguucgaggcgacggcccgcggcgcccggcgcauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucaccuggaucggccugaacuccaagaacacgagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacaccuggacggagcaguacaaguuccaggccgacagccccaagcgccuggcgaccgccaucgccggcgccugggagaacggggugugcggcauccgguccaccacccgcauggagaaccuccuguggaagcagaucgccaacgagcugaacuacauccucugggagaacaacaucaagcugacggucguggugggggacaucaucggcguccuggagcagggcaagcggacccucacgccccagccgauggagcugaaguacagcuggaagaccugggggaaggcgaagaucgugacggccgagacccagaacuccagcuucaucaucgacggccccaacacccccgagugccccuccgccagccgcgccuggaacgugugggaggucgaggacuacggguucggcguguucaccacgaacaucuggcugaagcuccgggagguguacacccaguccugcgaccaccgccugaugagcgcggccaucaaggacgagcgggccguccacgccgacaugggcuacuggaucgagagccagaagaacggguccuggaagcuggagaaggccagcuucaucgaggugaagaccugcaccuggccgaagucccacacccucuggagcaacggcgugcuggaguccgacaugaucauccccaagagccuggcggggcccaucucccagcacaaccaccgcccgggcuaccacacgcagaccgccgggcccuggcaccucggcaagcuggagcuggacuucaacuacugcgagggcaccaccgucgugaucacggagaacugcgggacccggggccccagccuccgcaccaccacgguguccgggaagcugauccacgaguggugcugccggagcugcacccugcccccgcuccgcuacaugggcgaggacgggugcugguacggcauggagauccggcccaucaacgagaaggaggagaacauggucaagucccuggugagcgccggcuccgggaagguggacaacuucaccaugggcguccugugccucgccauccuguucgaggaggugaugcgcgggaaguucggcaagaagcacaugaucgccggggugcuguucaccuucguccuccugcugagcggccagaucacguggcgggacauggcgcacacccucaucaugaucggcuccaacgccagcgaccgcauggggaugggcgugaccuaccuggcccugaucgccaccuucaagauccagcccuuccucgcccugggguucuuccugcggaagcucacgucccgcgagaaccugcugcucggcgugggccuggcgauggccaccacccugcagcuccccgaggacaucgagcagauggccaacgggaucgcccugggccugaugacccucaagcugaucacgcaguucgagaccuaccagcuguggaccgcgcucgucagccugaccugcagcaacacgaucuucacccugaccguggccuggcggaccgccacgcucauccuggccggggucucccugcucccgcugugccagagcuccagcaugcgcaagaccgacuggcugcccaugaccguggccgcgaugggcgugccgccccucccgcuguucaucuucucccugaaggacacccccaagcgccggagcuggccccucaacgagggggucauggccgugggccugguguccauccuggccagcucccuccugcgcaacgacguccccauggccggcccgcugguggccgggggccuccugaucgcgugcuacgugaucacggggaccagcgccgaccugaccgucgagaaggccgccgacgugaccugggaggaggaggccgagcagacgggcgugucccacaaccucaugaucaccgucgacgacgacgggaccaugcggaucaaggacgacgagaccgagaacauccugaccgugcugcucaagacggcgcugcugaucgugagcggcaucuuccccuacuccauccccgccacccuccuggucuggcacaccuggcagaagcagacccagcgcagcggcgugcugugggacgugcccuccccgcccgagacgcagaaggccgagcucgaggagggggucuaccggaucaagcagcagggcaucuucgggaagacccaggugggcguggggguccagaaggagggcguguuccacaccauguggcacgugacccgcggcgccguccugacgcacaacgggaagcggcuggagcccaacugggccagcgugaagaaggaccucaucuccuacggcgggggcuggcgccugagcacccaguggcagaagggggaggaggugcaggucaucgcgguggagcccggcaagaacccgaagaacuuccagaccaugcccggcaucuuccagaccacgaccggggagaucggcgccaucgcccuggacuucaagcccgggaccuccggcagcccgaucaucaaccgggagggcaagguggucgggcuguacggcaacgggguggugaccaagaacggcggguacgucagcggcaucgcccagacgaacgcggagcccgacggccccacccccgagcucgaggaggagauguucaagaagcgcaaccugaccaucauggaccugcacccgggguccggcaagacccggaaguaccuccccgccaucgugcgcgaggccaucaagcggcgccugcggacgcugauccucgcccccacccgcguggucgccgcggagauggaggaggcccugaaggggcugcccauccgguaccagaccaccgccaccaagagcgagcacaccggccgcgagaucguggaccucaugugccacgccaccuucaccaugcggcugcuguccccggugcgcguccccaacuacaaccucaucaucauggacgaggcccacuucacggaccccgcgagcaucgccgcccggggguacaucuccacccgcgugggcaugggcgaggccgccgcgaucuucaugaccgccacgccgcccgggacggccgaggccuucccccagagcaacgcgcccauccaggacgaggagcgcgacauccccgagcgguccuggaacagcggcaacgaguggaucaccgacuucguggggaagaccgucugguucgugcccuccaucaaggccggcaacgacaucgccaacugccugcgcaagaacgggaagaaggugauccagcugagccggaagaccuucgacacggaguaccagaagacccgccucaacgacugggacuucgucgugaccaccgacaucuccgagaugggcgccaacuucaaggccgaccgggugaucgacccccgccggugccugaagcccgucauccugacggacggccccgagcgcgugauccucgcggggccgaugcccgugaccgccgccagcgccgcccagcggcgcggccgggucgggcgcaacccccagaaggagaacgaccaguacaucuucaccggccagccccugaacaacgacgaggaccacgcgcacuggaccgaggccaagaugcugcucgacaacaucaacaccccggaggggaucauccccgcccuguucgagcccgagcgggagaaguccgccgccaucgacggcgaguaccgccugaagggcgagagccggaagacguucguggagcucaugcgccgcggggaccugcccgucuggcuggcgcacaagguggccuccgagggcaucaaguacaccgaccgcaaguggugcuucgacggggagcggaacaaccagauccucgaggagaacauggacguggagaucuggaccaaggagggcgagcgcaagaagcugcgcccgcgguggcuggacgcccgcaccuacagcgacccccucgcccugaaggaguucaaggacuucgcggccggccggaaguccaucgccaucgaccuggucacggagaucgggcgcgugcccagccaccucgcccaccggacccgcaacgcccuggacaaccuggugaugcuccacaccuccgagcacggcgggcgggcguaccgccacgccgucgaggagcugccggagaccauggagacgcugcuccugcugggccucaugauccugcugaccgggggcgccaugcuguuccuggugagcggcaaggggaucggcaagaccaccaucgggcugaucugcgugaucgucagcuccggcaugcucuggauggccgacaucccccugcaguggaucgccagcgcgaucgugcuggaguucuucaugauggugcuccugauccccgagcccgagaagcagcggacgccgcaggacaaccagcuggccuacgucgugaucgggauccucacccuggccgccaucguggccgcgaacgagaugggccugcucgagaccaccaagcgcgaccugggcauguccaaggagcccggggucgugagccccacguccuaccuggacguggaccuccaccccgccagcgccuggacccuguacgccgucgccaccaccgugaucacgccgaugcugcggcacaccaucgagaacuccaccgcgaacgugagccucgccgccaucgccaaccaggcggucgugcugaugggccuggacaagggguggcccaucuccaagauggaccucggcgugccccugcuggcccucgggugcuacagccaggucaacccccugacccugacggccgccgugcuccugcuggugacccacuacgccaucaucggcccgggccuccaggcgaaggccacccgcgaggcccagaagcggaccgccgccgggaucaugaagaaccccacggucgacggcaucaugaccaucgaccuggaccccgugaucuacgacuccaaguucgagaagcagcugggccaggugaugcuccugguccugugcgcggugcagcuccugcugaugcgcaccagcugggcccucugcgaggcccugacccuggccacgggccccaucaccacccucugggagggcuccccggggaaguucuggaacaccacgaucgccgugagcauggcgaacaucuuccggggcuccuaccuggccggggccggccuggccuucagcaucaugaaguccgucgggaccggccgccggggcaccgggagccagggcgagacccucggggagaaguggaagaagaagcugaaccagcugucccgcaaggaguucgaccucuacaagaaguccggcaucaccgagguggaccggacggaggcgaaggaggggcugaagcgcggcgagaccacccaccacgccgugagccggggcuccgccaagcugcagugguucgucgagcgcaacauggugauccccgaggggcgcgugaucgaccucggcugcgggcggggcggguggagcuacuacugcgccggccugaagaaggucaccgaggugcgcggcuacacgaagggcgggcccgggcacgaggagcccgugccgauguccaccuacggcuggaacaucgucaagcugaugagcgggaaggacguguucuaccugccgcccgagaagugcgacacccugcugugcgacaucggcgaguccagccccuccccgaccguggaggagagccggacgauccgcguccugaagaugguggagcccuggcucaagaacaaccaguucugcaucaaggugcugaaccccuacaugcccaccgucaucgagcaccuggagcggcuccagcgcaaguacggcgggaugcuggugcggaacccgcugucccgcaacagcacccacgagauguacuggaucuccaacggcaccgggaacaucgugagcuccgucaacauggugagccggcuccugcugaaccgcuucacgaugacccaccggcgccccaccaucgagaaggacgucgaccucggcgccggcacccggcacgugaacgcggagcccgagacgccgaacauggacgugaucggggagcgcaucaagcggaucaaggaggagcacuccagcaccuggcacuacgacgacgagaaccccuacaagaccugggccuaccacggcuccuacgaggucaaggccaccgggagcgccuccagcaugaucaacggcguggugaagcugcugacgaagcccugggacgucgugcccauggugacccagauggccaugaccgacaccacgccguucgggcagcagcgcgucuucaaggagaagguggacacccggacgccccggcccaugcccggcacccggaaggugauggagaucacggcggaguggcucuggcgcacccugggccgcaacaagaagccgcggcugugcacccgcgaggaguucaccaagaagguccggacgaacgccgccaugggggccguguucaccgaggagaaccagugggacagcgcccgcgcggccguggaggacgaggaguucuggaagcucgucgaccgggagcgcgagcugcacaagcugggcaagugcggguccugcguguacaacaugaugggcaagcgggagaagaagcucggggaguucggcaaggccaagggcagccgcgccaucugguacauguggcugggggcgcgguuccuggaguucgaggcccucggcuuccugaacgaggaccacugguucucccgcgagaacagcuacuccgggguggagggcgaggggcugcacaagcucggcuacauccugcgggacaucagcaagauccccggcggggccauguacgccgacgacaccgccggcugggacacccgcaucacggaggacgaccugcacaacgaggagaagaucacccagcagauggaccccgagcaccggcagcucgcgaacgccaucuucaagcugaccuaccagaacaaggucgugaaggugcagcgccccaccccgaaggggaccgucauggacaucaucucccggaaggaccagcgcggcagcggccagguggggacguacggccugaacaccuucaccaacauggaggcccagcucgugcggcagauggagggggagggcguccuguccaagaccgaccuggagaacccccaccuccuggagaagaagaucacgcaguggcuggagaacaaggggguggagcgccucaagcggauggccaucagcggcgacgacugcguggucaagcccaucgacgaccgcuucgccaacgcgcugcuggcccucaacgacaugggcaaggugcggaaggacaucccccaguggcagccguccaagggguggcacgacuggcagcagguccccuucugcagccaccacuuccacgagcugaucaugaaggacggccgcaagcuggucgugcccugccgcccccaggacgagcucaucgggcgggcccgcaucucccagggcgccggguggagccugaaggagaccgccugccugggcaaggcguacgcccagauguggucccucauguacuuccaccggcgcgaccugcggcuggccagcaacgccaucugcuccgccgugccgguccacugggugcccaccagccgcaccacgugguccauccacgcgcaccaccaguggaugaccaccgaggacaugcucaccguguggaaccgggucuggaucgaggacaaccccuggauggaggacaagacgcccgugaccaccugggaggacgugccguaccugggcaagcgcgaggaccaguggugcgggagccugaucggccucaccagccgggccacgugggcccagaacauccugaccgccauccagcagguccgcucccugaucggggacgaggaguuccucgacuacaugcccagcaugaagcgguuccgcaaggaggaggaguccgagggcgcgaucugguga

SEQ ID NO: 9961 - RNA, 9873 nt, Artificial Sequence
  derived and/or modified CDS sequence (opt1) from DENV-3__GQ868626__SS-prME
accagccugugccucaugaugaugcugcccgccacccuggccuuccaccucaccagccgggacggcgagccccggaugaucguggggaagaacgagcgcggcaagagccugcuguucaagaccgcgaccgggaucaacaugugcacccucaucgccauggaccugggcgagaugugcgacgacacggugaccuacaagugcccccugaucgccgagguggagcccgaggacaucgacugcuggugcaaccucaccuccaccugggugacguacgggaccugcaaccaggccggcgagcaccggcgcgacaagcggagcguggcccuggcgccccacgugggcauggggcuggacacccgcacccagacguggauguccgccgagggcgccuggcgccagguggagaaggucgagaccugggcccuccgccacccgggguucaccauccuggcgcuguuccucgcccacuacaucggcaccagccugauccagaagguggugaucuucauccugcucaugcuggucacgcccuccaugaccaugcggugcgugggggugggcaaccgcgacuucgucgagggccugagcggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacucccgcugccccacgcagggcgaggccauccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccuccaccguggaggccgugcugcccgaguacggcacccucgggcuggagugcagcccgcgcaccggccuggacuucaacgagaugauccuccugaccaugaagaacaaggcguggaugguccaccggcagugguucuucgaccugccccuccccuggacguccggcgccaccaucgagacccccaccuggaaccgcaaggagcugcuggugacguucaagaacgcccacgccaagaagcaggagguggucgugcucgggagccaggagggcgccaugcacaccgcgcugaccggggccaccgagauccagaacuccggcgggacgagcaucuucgccggccaccugaagugccggcucaagauggacaagcuggagcugaagggcauguccuacgccaugugccucaacaccuucgugcugcgcaaggaggucagcgagacccagcacgggaccauccugaucaagguggaguacaagggcgaggacgccccgugcaagauccccuucuccacggaggacgggcagggcaaggcgcacaacggccggcugaucaccgccaaccccguggucaccaagaaggaggagcccgugaacaucgaggccgagccgcccuucggggagagcaacaucgugaucggcaucggggacaaggcccucaagaucaacugguacaagaagggcagcuccaucgggaagauguucgaggcgaccgcccgcggcgcccggcgcauggccauccugggcgacacggccugggacuucgggagcgucggcggggugcugaacucccucggcaagauggugcaccagaucuucgggagcgcguacaccgcccuguucuccggcgucagcuggaucaugaagaucggcaucggggugcugcucaccuggaucggccugaacuccaagaacaccagcauguccuucagcugcaucgugaucgggaucaucacgcuguaccucggcgccgucgugcaggccgacauggggugcgugaucaacuggaagggcaaggagcugaagugcggcuccgggaucuucgucaccaacgaggugcacaccuggaccgagcaguacaaguuccaggccgacagccccaagcgccuggcgacggccaucgccggcgccugggagaacggggugugcggcauccgguccaccacccgcauggagaaccuccuguggaagcagaucgccaacgagcugaacuacauccucugggagaacaacaucaagcugaccgucguggugggggacaucaucggcguccuggagcagggcaagcggacgcucacgccccagccgauggagcugaaguacagcuggaagaccugggggaaggcgaagaucgugaccgccgagacgcagaacuccagcuucaucaucgacggccccaacacccccgagugccccuccgccagccgcgccuggaacgugugggaggucgaggacuacggguucggcguguucaccaccaacaucuggcugaagcuccgggagguguacacgcaguccugcgaccaccgccugaugagcgcggccaucaaggacgagcgggccguccacgccgacaugggcuacuggaucgagagccagaagaacggguccuggaagcuggagaaggccagcuucaucgaggugaagaccugcaccuggccgaagucccacacccucuggagcaacggcgugcuggaguccgacaugaucauccccaagagccuggcggggcccaucucccagcacaaccaccgcccgggcuaccacacccagacggccgggcccuggcaccucggcaagcuggagcuggacuucaacuacugcgagggcaccaccgucgugaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucaacgagaaggaggagaacauggucaagucccuggugagcgccggcuccgggaagguggacaacuucaccaugggcguccugugccucgccauccuguucgaggaggugaugcgcgggaaguucggcaagaagcacaugaucgccggggugcuguucaccuucguccuccugcugagcggccagaucaccuggcgggacauggcgcacacgcucaucaugaucggcuccaacgccagcgaccgcauggggaugggcgugaccuaccuggcccugaucgccaccuucaagauccagcccuuccucgcccugggguucuuccugcggaagcucaccucccgcgagaaccugcugcucggcgugggccuggcgauggccacgacccugcagcuccccgaggacaucgagcagauggccaacgggaucgcccugggccugaugacccucaagcugaucacccaguucgagacguaccagcuguggaccgcgcucgucagccugaccugcagcaacaccaucuucacgcugaccguggccuggcggaccgccacccucauccuggccggggucucccugcucccgcugugccagagcuccagcaugcgcaagacggacuggcugcccaugaccguggccgcgaugggcgugccgccccugccgcuguucaucuucucccugaaggacacccccaagcgccggagcuggccccucaacgagggggucauggccgugggccugguguccauccuggccagcucccuccugcgcaacgacguccccauggccggcccgcugguggccgggggccuccugaucgcgugcuacgugaucaccgggacgagcgccgaccugaccgucgagaaggccgccgacgugaccugggaggaggaggccgagcagaccggcgugucccacaaccucaugaucacggucgacgacgacgggaccaugcggaucaaggacgacgagaccgagaacauccugaccgugcugcucaagaccgcgcugcugaucgugagcggcaucuuccccuacuccauccccgccacgcuccuggucuggcacaccuggcagaagcagacccagcgcagcggcgugcugugggacgugcccuccccgcccgagacccagaaggccgagcucgaggagggggucuaccggaucaagcagcagggcaucuucgggaagacccaggugggcguggggguccagaaggagggcguguuccacaccauguggcacgugacccgcggcgccguccugacccacaacgggaagcggcuggagcccaacugggccagcgugaagaaggaccucaucuccuacggcgggggcuggcgccugagcacgcaguggcagaagggggaggaggugcaggucaucgcgguggagcccggcaagaacccgaagaacuuccagaccaugcccggcaucuuccagaccaccacgggggagaucggcgccaucgcccuggacuucaagcccgggaccuccggcagcccgaucaucaaccgggagggcaagguggucgggcuguacggcaacgggguggugaccaagaacggcggguacgucagcggcaucgcccagaccaacgcggagcccgacggccccacgcccgagcucgaggaggagauguucaagaagcgcaaccugaccaucauggaccugcacccgggguccggcaagacccggaaguaccuccccgccaucgugcgcgaggccaucaagcggcgccugcggacccugauccucgcccccacgcgcguggucgccgcggagauggaggaggcccugaaggggcugcccauccgguaccagaccaccgccaccaagagcgagcacacgggccgcgagaucguggaccucaugugccacgccaccuucaccaugcggcugcuguccccggugcgcguccccaacuacaaccucaucaucauggacgaggcccacuucaccgaccccgcgagcaucgccgcccggggguacaucuccacgcgcgugggcaugggcgaggccgccgcgaucuucaugaccgccacgccgcccgggaccgccgaggccuucccccagagcaacgcgcccauccaggacgaggagcgcgacauccccgagcgguccuggaacagcggcaacgaguggaucacggacuucguggggaagaccgucugguucgugcccuccaucaaggccggcaacgacaucgccaacugccugcgcaagaacgggaagaaggugauccagcugagccggaagaccuucgacaccgaguaccagaagacgcgccucaacgacugggacuucgucgugaccaccgacaucuccgagaugggcgccaacuucaaggccgaccgggugaucgacccccgccggugccugaagcccgucauccugaccgacggccccgagcgcgugauccucgcggggccgaugcccgugacggccgccagcgccgcccagcggcgcggccgggucgggcgcaacccccagaaggagaacgaccaguacaucuucaccggccagccccugaacaacgacgaggaccacgcgcacuggaccgaggccaagaugcugcucgacaacaucaacaccccggaggggaucauccccgcccuguucgagcccgagcgggagaaguccgccgccaucgacggcgaguaccgccugaagggcgagagccggaagaccuucguggagcucaugcgccgcggggaccugcccgucuggcuggcguacaagguggccuccgagggcaucaaguacacggaccgcaaguggugcuucgacggggagcggaacaaccagauccucgaggagaacauggacguggagaucuggaccaaggagggcgagcgcaagaagcugcgcccgcgguggcuggacgcccgcaccuacagcgacccccucgcccugaaggaguucaaggacuucgcggccggccggaaguccaucgcccuggaccucgucaccgagaucgggcgcgugcccagccaccuggcccaccggacgcgcaacgcccuggacaaccucgugaugcugcacaccuccgagcacggcgggcgggcguaccgccacgccgucgaggagcugccggagaccauggagacccuccugcugcucggccugaugauccugcucaccggcggggccaugcuguuccugaucagcgggaaggggaucggcaagaccaccaucgggcucaucugcgugaucgugagcuccggcaugcuguggauggccgacaucccccugcaguggaucgccagcgcgaucguccucgaguucuucaugauggugcugcugauccccgagcccgagaagcagcggaccccgcaggacaaccagcucgccuacguggucaucgggauccugacgcuggccgccaucguggccgcgaacgagaugggccuccuggagaccaccaagcgcgaccugggcauguccaaggagcccgggguggucagccccaccuccuaccucgacguggaccugcaccccgccagcgccuggacgcuguacgccguggccaccaccgucaucaccccgaugcuccggcacacgaucgagaacuccaccgcgaacgugagccuggccgccaucgccaaccaggcggugguccugaugggccucgacaagggguggcccaucuccaagauggaccugggcgugccccugcucgcccuggggugcuacagccaggugaacccccugacccucaccgccgccguccugcugcucgugacgcacuacgccaucaucggcccgggccugcaggcgaaggccacccgcgaggcccagaagcggaccgccgccgggaucaugaagaaccccaccguggacggcaucaugacgaucgaccuggaccccgucaucuacgacuccaaguucgagaagcagcucggccaggugaugcugcuggugcucugcgcgguccagcugcugcucaugcgcaccagcugggcccugugcgaggcccugacccucgccaccggccccaucacgacccugugggagggcuccccggggaaguucuggaacaccaccaucgccgugagcauggcgaacaucuuccggggcuccuaccuggccggggccggccucgccuucagcaucaugaaguccguggggacgggccgccggggcaccgggagccagggcgagacccugggggagaaguggaagaagaagcugaaccagcucucccgcaaggaguucgaccuguacaagaaguccggcaucaccgaggucgaccggaccgaggcgaaggaggggcugaagcgcggcgagacgacccaccacgccgugagccggggcuccgccaagcuccagugguucguggagcgcaacauggucauccccgaggggcgcgugaucgaccugggcugcgggcggggcggguggagcuacuacugcgccggccugaagaaggugaccgagguccgcggcuacaccaagggcgggcccgggcacgaggagcccgugccgauguccacguacggcuggaacaucgugaagcucaugagcgggaaggacgucuucuaccugccgcccgagaagugcgacacccugcugugcgacaucggcgaguccagccccuccccgaccguggaggagagccggaccauccgcgugcucaagauggucgagcccuggcugaagaacaaccaguucugcaucaaggugcugaaccccuacaugcccacggugaucgagcaccucgagcggcugcagcgcaaguacggcgggaugcugguccggaacccgcucucccgcaacagcacccacgagauguacuggaucuccaacggcaccgggaacaucgugagcuccgugaacauggucagccggcugcugcucaaccgcuucaccaugacgcaccggcgccccaccaucgagaaggacguggaccugggcgccggcacccggcacgucaacgcggagcccgagaccccgaacauggacgugaucggggagcgcaucaagcggaucaaggaggagcacuccagcacguggcacuacgacgacgagaaccccuacaagaccugggccuaccacggcuccuacgaggugaaggccaccgggagcgccuccagcaugaucaacggcgucgugaagcugcucaccaagcccugggacgugguccccauggugacgcagauggccaugaccgacaccaccccguucgggcagcagcgcguguucaaggagaaggucgacacgcggacgccccggcccaugcccggcacccggaaggugauggagaucaccgcggaguggcuguggcgcacgcugggccgcaacaagaagccgcggcucugcacccgcgaggaguucaccaagaaggugcggaccaacgccgccaugggggccgucuucacggaggagaaccagugggacagcgcccgcgcggccguggaggacgaggaguucuggaagcugguggaccgggagcgcgagcugcacaagcucggcaagugcggguccugcgucuacaacaugaugggcaagcgggagaagaagcugggggaguucggcaaggccaagggcagccgcgccaucugguacauguggcugggggcgcgguuccucgaguucgaggcccugggcuuccugaacgaggaccacugguucucccgcgagaacagcuacuccgggguggagggcgaggggcuccacaagcugggcuacauccugcgggacaucagcaagauccccggcggggccauguacgccgacgacaccgccggcugggacacccgcaucaccgaggacgaccuccacaacgaggagaagaucacgcagcagauggaccccgagcaccggcagcuggcgaacgccaucuucaagcugaccuaccagaacaagguggucaaggugcagcgccccaccccgaaggggaccgugauggacaucaucucccggaaggaccagcgcggcagcggccaggucgggaccuacggccucaacacguucaccaacauggaggcccagcuggugcggcagauggagggggagggcgugcuguccaaggccgaccucgagaacccccaccuccuggagaagaagaucacccaguggcucgagaacaagggggucgagcgccugaagcggauggccaucagcggcgacgacugcguggugaagcccaucgacgaccgcuucgcgaacgcccugcucgcccugaacgacaugggcaagguccggaaggacaucccccaguggcagccguccaagggguggcacgacuggcagcagguccccuucugcagccaccacuuccacgagcugaucaugaaggacggccgcaagcucgugguccccugccgcccccaggacgagcugaucgggcgggcccgcaucucccagggcgccggguggagccugaaggagaccgcgugccucggcaaggccuacgcccagauguggucccugauguacuuccaccggcgcgaccugcggcucgccagcaacgccaucugcuccgcggugccggugcacuggguccccacgagccgcaccaccugguccauccacgcccaccaccaguggaugaccacggaggacaugcuggccguguggaaccggguguggaucgaggacaaccccuggauggaggacaagacccccgucaccaccugggaggacgugccguaccugggcaagcgcgaggaccaguggugcgggagccucaucggccugacgagccgggccaccugggcgcagaacauccugaccgccauccagcagguccgcucccucaucggggacgaggaguuccuggacuacaugcccagcaugaagcgguuccgcaaggaggaggaguccgagggcgccaucugguga

SEQ ID NO: 9962 - RNA, 9873 nt, Artificial Sequence
  derived and/or modified CDS sequence (opt1) from DENV-3__GQ868627__SS-prME
accagccugugccucaugaugaugcugcccgccacccuggccuuccaccucaccagccgggacggggagccccggaugaucguggggaagaacgagcgcggcaagagccugcuguucaagaccgcgaccgggaucaacaugugcacccucaucgccauggaccugggcgagaugugcgacgacaccgugaccuacaagugcccccugaucgccgagguggagcccgaggacaucgacugcuggugcaaccucaccuccaccugggugacguacgggaccugcaaccaggccggcgagcaccggcgcgacaagcggagcguggcccuggcgccccacgugggcauggggcuggacacccgcacccagacguggauguccgccgagggcgccuggcgccagguggagaaggucgagaccugggcccuccgccacccgggguucaccauccuggcgcuguuccucgcccacuacaucggcaccagccugauccagaagguggugaucuucauccugcucaugcuggucacgcccuccaugaccaugcggugcgugggggugggcaaccgcgacuucgucgagggccugagcggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacucccgcugccccacgcagggcgaggccauccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccuccaccguggaggccgugcugcccgaguacggcacccucgggcuggagugcagcccgcgcaccggccuggacuucaacgagaugauccuccugaccaugaagaacaaggcguggaugguccaccggcagugguucuucgaccugccccuccccuggacguccggcgccaccaccgagacccccacguggaaccgcaaggagcugcuggugaccuucaagaacgcccacgccaagaagcaggagguggucgugcucgggagccaggagggcgccaugcacaccgcgcugaccggggccacggagauccagaacuccggcgggaccagcaucuucgccggccaccugaagugccggcucaagauggacaagcuggagcugaagggcauguccuacgccaugugccucaacaccuucgugcugcgcaaggaggucagcgagacccagcacgggacgauccugaucaagguggaguacaagggcgaggacgccccgugcaagauccccuucuccaccgaggacgggcagggcaaggcgcacaacggccggcugaucaccgccaaccccguggucaccaagaaggaggagcccgugaacaucgaggccgagccgcccuucggggagagcaacaucgugaucggcaucggggacaaggcccucaagaucaacugguacaagaagggcagcuccaucgggaagauguucgaggcgacggcccgcggcgcccggcgcauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucaccuggaucggccugaacuccaagaacacgagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacaccuggacggagcaguacaaguuccaggccgacagccccaagcgccuggcgaccgccaucgccggcgccugggagaacggggugugcggcauccgguccaccacccgcauggagaaccuccuguggaagcagaucgccaacgagcugaacuacauccucugggagaacaacaucaagcugacggucguggugggggacaucaucggcguccuggagcagggcaagcggacccucacgccccagccgauggagcugaaguacagcuggaagaccugggggaaggcgaagaucgugacggccgagacccagaacuccagcuucaucaucgacggccccaacacccccgagugccccuccgccagccgcgccuggaacgugugggaggucgaggacuacggguucggcguguucaccacgaacaucuggcugaagcuccgggagguguacacccaguccugcgaccaccgccugaugagcgcggccaucaaggacgagcgggccguccacgccgacaugggcuacuggaucgagagccagaagaacggguccuggaagcuggagaaggccagcuucaucgaggugaagaccugcaccuggccgaagucccacacccucuggagcaacggcgugcuggaguccgacaugaucauccccaagagccuggcggggcccaucucccagcacaaccaccgcccgggcuaccacacgcagaccgccgggcccuggcaccucggcaagcuggagcuggacuucaacuacugcgagggcaccaccgucgugaucacggagaacugcgggacccggggccccagccuccgcaccaccacgguguccgggaagcugauccacgaguggugcugccggagcugcacccugcccccgcuccgcuacaugggcgaggacgggugcugguacggcauggagauccggcccaucaacgagaaggaggagaacauggucaagucccuggugagcgccggcuccgggaagguggacaacuucaccaugggcguccugugccucgccauccuguucgaggaggugaugcgcgggaaguucggcaagaagcacaugaucgccggggugcuguucaccuucguccuccugcugagcggccagaucacguggcgggacauggcgcacacccucaucaugaucggcuccaacgccagcgaccgcauggggaugggcgugaccuaccuggcccugaucgccaccuucaagauccagcccuuccucgcccugggguucuuccugcggaagcucacgucccgcgagaaccugcugcucggcgugggccuggcgauggccaccacccugcagcuccccgaggacaucgagcagauggccaacgggaucgcccugggccugaugacccucaagcugaucacgcaguucgagaccuaccagcuguggaccgcgcucgucagccugaccugcagcaacacgaucuucacccugaccguggccuggcggaccgccacgcucauccuggccggggucucccugcucccgcugugccagagcuccagcaugcgcaagaccgacuggcugcccaugaccguggccgcgaugggcgugccgccccugccgcuguucaucuucucccugaaggacacccccaagcgccggagcuggccccucaacgagggggucauggccgugggccugguguccauccuggccagcucccuccugcgcaacgacguccccauggccggcccgcugguggccgggggccuccugaucgcgugcuacgugaucacggggaccagcgccgaccugaccgucgagaaggccgccgacgugaccugggaggaggaggccgagcagacgggcgugucccacaaccucaugaucaccgucgacgacgacgggaccaugcggaucaaggacgacgagaccgagaacauccugaccgugcugcucaagacggcgcugcugaucgugagcggcaucuuccccuacuccauccccgccacccuccuggucuggcacaccuggcagaagcagacccagcgcagcggcgugcugugggacgugcccuccccgcccgagacgcagaaggccgagcucgaggagggggucuaccggaucaagcagcagggcaucuucgggaagacccaggugggcguggggguccagaaggagggcguguuccacaccauguggcacgugacccgcggcgccguccugacgcacaacgggaagcggcuggagcccaacugggccagcgugaagaaggaccucaucuccuacggcgggggcuggcgccugagcacccaguggcagaagggggaggaggugcaggucaucgcgguggagcccggcaagaacccgaagaacuuccagaccaugcccggcaucuuccagaccacgaccggggagaucggcgccaucgcccuggacuucaagcccgggaccuccggcagcccgaucaucaaccgggagggcaagguggucgggcuguacggcaacgggguggugaccaagaacggcggguacgucagcggcaucgcccagacgaacgcggagcccgacggccccacccccgagcucgaggaggagauguucaagaagcgcaaccugaccaucauggaccugcacccgggguccggcaagacccggaaguaccuccccgccaucgugcgcgaggccaucaagcggcgccugcggacgcugauccucgcccccacccgcguggucgccgcggagauggaggaggcccugaaggggcugcccauccgguaccagaccaccgccaccaagagcgagcacaccggccgcgagaucguggaccucaugugccacgccaccuucaccaugcggcugcuguccccggugcgcguccccaacuacaaccucaucaucauggacgaggcccacuucacggaccccgcgagcaucgccgcccggggguacaucuccacccgcgugggcaugggcgaggccgccgcgaucuucaugaccgccacgccgcccgggacggccgaggccuucccccagagcaacgcgcccauccaggacgaggagcgcgacauccccgagcgguccuggaacagcggcaacgaguggaucaccgacuucguggggaagaccgucugguucgugcccuccaucaaggccggcaacgacaucgccaacugccugcgcaagaacgggaagaaggugauccagcugagccggaagaccuucgacacggaguaccagaagacccgccucaacgacugggacuucgucgugaccaccgacaucuccgagaugggcgccaacuucaaggccgaccgggugaucgacccccgccggugccugaagcccgucauccugacggacggccccgagcgcgugauccucgcggggccgaugcccgugaccgccgccagcgccgcccagcggcgcggccgggucgggcgcaacccccagaaggagaacgaccaguacaucuucaccggccagccccugaacaacgacgaggaccacgcgcacuggaccgaggccaagaugcugcucgacaacaucaacaccccggaggggaucauccccgcccuguucgagcccgagcgggagaaguccgccgccaucgacggcgaguaccgccugaagggcgagagccggaagacguucguggagcucaugcgccgcggggaccugcccgucuggcuggcguacaagguggccuccgagggcaucaaguacaccgaccgcaaguggugcuucgacggggagcggaacaaccagauccucgaggagaacauggacguggagaucuggaccaaggagggcgagcgcaagaagcugcgcccgcgguggcuggacgcccgcaccuacagcgacccccucgcccugaaggaguucaaggacuucgcggccggccggaaguccaucgcccuggaccucgucacggagaucgggcgcgugcccagccaccuggcccaccggacccgcaacgcccuggacaaccucgugaugcugcacaccuccgagcacggcgggcgggcguaccgccacgccgucgaggagcugccggagaccauggagacgcuccugcugcucggccugaugauccugcucaccgggggcgccaugcuguuccugaucagcggcaaggggaucggcaagaccaccaucgggcucaucugcgugaucgugagcuccggcaugcuguggauggccgacaucccccugcaguggaucgccagcgcgaucguccucgaguucuucaugauggugcugcugauccccgagcccgagaagcagcggacgccgcaggacaaccagcucgccuacguggucaucgggauccugacccuggccgccaucguggccgcgaacgagaugggccuccuggagaccaccaagcgcgaccugggcauguccaaggagcccgggguggucagccccacguccuaccucgacguggaccugcaccccgccagcgccuggacccuguacgccguggccaccaccgucaucacgccgaugcuccggcacaccaucgagaacuccaccgcgaacgugagccuggccgccaucgccaaccaggcggugguccugaugggccucgacaagggguggcccaucuccaagauggaccugggcgugccccugcucgcccuggggugcuacagccaggugaacccccugacccucacggccgccguccugcugcucgugacccacuacgccaucaucggcccgggccugcaggcgaaggccacccgcgaggcccagaagcggaccgccgccgggaucaugaagaaccccacgguggacggcaucaugaccaucgaccuggaccccgucaucuacgacuccaaguucgagaagcagcucggccaggugaugcugcuggugcucugcgcgguccagcugcugcucaugcgcaccagcugggcccugugcgaggcccugacccucgccacgggccccaucaccacccugugggagggcuccccggggaaguucuggaacaccacgaucgccgugagcauggcgaacaucuuccggggcuccuaccuggccggggccggccucgccuucagcaucaugaaguccguggggaccggccgccggggcaccgggagccagggcgagacccugggggagaaguggaagaagaagcugaaccagcucucccgcaaggaguucgaccuguacaagaaguccggcaucaccgaggucgaccggacggaggcgaaggaggggcugaagcgcggcgagaccacccaccacgccgugagccggggcuccgccaagcuccagugguucguggagcgcaacauggucauccccgaggggcgcgugaucgaccugggcugcgggcggggcggguggagcuacuacugcgccggccugaagaaggugaccgagguccgcggcuacacgaagggcgggcccgggcacgaggagcccgugccgauguccaccuacggcuggaacaucgugaagcucaugagcgggaaggacgucuucuaccugccgcccgagaagugcgacacccugcugugcgacaucggcgaguccagccccuccccgaccguggaggagagccggacgauccgcgugcucaagauggucgagcccuggcugaagaacaaccaguucugcaucaaggugcugaaccccuacaugcccaccgugaucgagcaccucgagcggcugcagcgcaaguacggcgggaugcugguccggaacccgcucucccgcaacagcacccacgagauguacuggaucuccaacggcaccgggaacaucgugagcuccgugaacauggucagccggcugcugcucaaccgcuucacgaugacccaccggcgccccaccaucgagaaggacguggaccugggcgccggcacccggcacgucaacgcggagcccgagacgccgaacauggacgugaucggggagcgcaucaagcggaucaaggaggagcacuccagcaccuggcacuacgacgacgagaaccccuacaagaccugggccuaccacggcuccuacgaggugaaggccaccgggagcgccuccagcaugaucaacggcgucgugaagcugcucacgaagcccugggacgugguccccauggugacccagauggccaugaccgacaccacgccguucgggcagcagcgcguguucaaggagaaggucgacacccggacgccccggcccaugcccggcacccggaaggugauggagaucacggcggaguggcuguggcgcacccugggccgcaacaagaagccgcggcucugcacccgcgaggaguucaccaagaaggugcggacgaacgccgccaugggggccgucuucaccgaggagaaccagugggacagcgcccgcgcggccguggaggacgaggaguucuggaagcugguggaccgggagcgcgagcugcacaagcucggcaagugcggguccugcgucuacaacaugaugggcaagcgggagaagaagcugggggaguucggcaaggccaagggcagccgcgccaucugguacauguggcugggggcgcgguuccucgaguucgaggcccugggcuuccugaacgaggaccacugguucucccgcgagaacagcuacuccgggguggagggcgaggggcuccacaagcugggcuacauccugcgggacaucagcaagauccccggcggggccauguacgccgacgacaccgccggcugggacacccgcaucacggaggacgaccuccacaacgaggagaagaucacccagcagauggaccccgagcaccggcagcuggcgaacgccaucuucaagcugaccuaccagaacaagguggucaaggugcagcgccccaccccgaaggggaccgugauggacaucaucucccggaaggaccagcgcggcagcggccaggucgggacguacggccucaacaccuucaccaacauggaggcccagcuggugcggcagauggagggggagggcgugcuguccaaggccgaccucgagaacccccaccuccuggagaagaagaucacccaguggcucgagaacaagggggucgagcgccugaagcggauggccaucagcggcgacgacugcguggugaagcccaucgacgaccgcuucgcgaacgcccugcucgcccugaacgacaugggcaagguccggaaggacaucccccaguggcagccguccaagggguggcacgacuggcagcagguccccuucugcagccaccacuuccacgagcugaucaugaaggacggccgcaagcucgugguccccugccgcccccaggacgagcugaucgggcgggcccgcaucucccagggcgccggguggagccugaaggagacggcgugccucggcaaggccuacgcccagauguggucccugauguacuuccaccggcgcgaccugcggcucgccagcaacgccaucugcuccgcggugccggugcacuggguccccaccagccgcaccaccugguccauccacgcccaccaccaguggaugacgaccgaggacaugcuggccguguggaaccggguguggaucgaggacaaccccuggauggaggacaagacccccgucaccacgugggaggacgugccguaccugggcaagcgcgaggaccaguggugcgggagccucaucggccugaccagccgggccaccugggcgcagaacauccugaccgccauccagcagguccgcucccucaucggggacgaggaguuccuggacuacaugcccagcaugaagcgguuccgcaaggaggaggaguccgagggcgccaucugguga

SEQ ID NO: 9963 - RNA, 9873 nt, Artificial Sequence
  derived and/or modified CDS sequence (opt1) from DENV-3__FJ639721__SS-prME
accagccugugccucaugaugaugcugcccgccacccuggccuuccaccucaccagccgcgacggcgagccccggaugaucguggggaagaacgagcgcggcaagagccugcuguucaagaccgccaccgggaucaacaugugcacccucaucgccauggaccugggcgagaugugcgacgacaccgucaccuacaagugcccccugaucguggagguggagcccgaggacaucgacugcuggugcaaccucaccuccaccugggucacguacgggaccugcaaccaggccggcgagcaccggcgcgacaagcggagcguggcccuggcgccccacgugggcauggggcuggacacccgcacccagacguggauguccgcggagggcgccuggcggcaggucgagaagguggagaccugggcccuccgccacccgggguucaccauccuggcccuguuccucgcgcacuacaucggcaccagccugauccagaagguggucaucuucauccugcucaugcuggugacgcccuccaugaccaugcggugcgugggggucggcaaccgcgacuucguggagggccugagcggggccaccuggguggacgucgugcucgagcacggcgggugcgugaccacgauggccaagaacaagcccacccuggacaucgagcugcagaagaccgaggccacccagcucgccacgcugcggaagcugugcaucgagggcaagaucaccaacaucaccaccgacucccgcugccccacgcagggcgaggcgauccucccggaggagcaggaccagaacuacgucugcaagcacaccuacguggaccggggguggggcaacgggugcggccuguucgggaagggcagccuggugaccugcgccaaguuccagugccucgagcccaucgagggcaaggucgugcaguacgagaaccugaaguacaccgugaucaucacgguccacaccggggaccagcaccaggugggcaacgacacccagggggucaccguggagaucacgccccaggccuccaccguggaggccguccugcccgaguacggcacccucgggcuggagugcagcccgcgcaccggccuggacuucaacgagaugauccuccugaccaugaagaacaaggccuggauggugcaccggcagugguucuucgaccugccccuccccuggacguccggcgcgaccaccgagacccccacguggaaccgcaaggagcugcuggugaccuucaagaacgcccacgccaagaagcaggaggucguggugcucgggagccaggagggcgccaugcacaccgcccugaccggggcgacggagauccagaacuccggcgggaccagcaucuucgccggccaccugaagugccggcucaagauggacaagcuggagcugaagggcauguccuacgccaugugccucaacaccuucguccugaagaaggaggugagcgagacccagcacgggacgauccugaucaagguggaguacaagggcgaggacgccccgugcaagauccccuucuccaccgaggacgggcagggcaaggcccacaacggccgccugaucaccgcgaaccccgucgugaccaagaaggaggagcccgugaacaucgaggccgagccgcccuucggggagagcaacaucgucaucggcaucggggacaaggcccucaagaucaacugguacaagaagggcagcuccaucgggaagauguucgaggccacggcgcggggcgcccgccggauggccauccugggcgacaccgccugggacuucgggagcgugggcggggugcugaacucccucggcaagaugguccaccagaucuucgggagcgccuacaccgcgcuguucuccggcgugagcuggaucaugaagaucggcaucggggugcugcucaccuggaucggccugaacuccaagaacacgagcauguccuucagcugcaucgucaucgggaucaucacccuguaccucggcgccguggugcaggccgacauggggugcgucaucaacuggaagggcaaggagcugaagugcggcuccgggaucuucgugaccaacgaggugcacaccuggacggagcaguacaaguuccaggccgacagccccaagcgccuggccaccgcgaucgccggcgccugggagaacggggucugcggcauccgcuccaccacccggauggagaaccuccuguggaagcagaucgccaacgagcugaacuacauccucugggagaacaacaucaagcugacggugguggucggggacaucaucggcgugcuggagcagggcaagcgcacccucacgccccagccgauggagcugaaguacagcuggaagaccugggggaaggccaagaucgugacggcggagacccagaacuccagcuucaucaucgacggccccaacacccccgagugccccuccgccagccgggccuggaacgucugggagguggaggacuacggguucggcguguucaccacgaacaucuggcugaagcuccgcgaggucuacacccaguccugcgaccaccggcugaugagcgccgcgaucaaggacgagcgcgccgugcacgccgacaugggcuacuggaucgagagccagaagaacggguccuggaagcuggagaaggccagcuucaucgaggugaagaccugcaccuggccgaagucccacacccucuggagcaacggcguccuggaguccgacaugaucauccccaagagccuggccgggcccaucucccagcacaaccaccggccgggcuaccacacgcagaccgcggggcccuggcaccucggcaagcuggagcuggacuucaacuacugcgagggcaccaccguggugaucacggagaacugcgggacccgcggccccagccuccggaccaccacggucuccgggaagcugauccacgaguggugcugccgcagcugcacccugcccccgcuccgguacaugggcgaggacgggugcugguacggcauggagauccgccccaucaacgagaaggaggagaacauggugaagucccuggugagcgccggcuccgggaaggucgacaacuucaccaugggcgugcugugccucgccauccuguucgaggaggugaugcgggggaaguucggcaagaagcacaugaucgccgggguccuguucaccuucgugcuccugcugagcggccagaucacguggcgcgacauggcccacacccucaucaugaucggcuccaacgcgagcgaccggauggggaugggcgugaccuaccuggcccugaucgccaccuucaagauccagcccuuccucacgcugggguucuuccugcgcaagcucaccucccgggagaaccugcugcucggcgucggccuggccauggccaccacccugcagcuccccgaggacaucgagcagauggcgaacgggaucgcccugggccugaugacgcucaagcugaucacccaguucgagaccuaccagcuguggaccgcccucgugagccugacgugcagcaacaccaucuucacccugaccgucgccuggcgcacggcgacccucauccuggccggggugucccugcucccgcugugccagagcuccagcaugcggaagaccgacuggcugcccaugaccguggccgccaugggcgugccgccccugccgcuguucaucuucucccugaaggacgcccccaagcgccgcagcuggccccucaacgagggggugauggcggugggccuggucuccauccuggccagcucccuccugcggaacgacgugcccauggccggcccgcugguggccgggggccuccugaucgccugcuacgucaucacggggaccagcgcggaccugaccguggagaaggccgccgacgugaccugggaggaggaggccgagcagacgggcgucucccacaaccucaugaucaccguggacgacgacgggaccaugcgcaucaaggacgacgagaccgagaacauccugaccgugcugcucaagacggcccugcugaucgucagcggcaucuuccccuacuccauccccgcgacccuccugguguggcacaccuggcagaagcagacccagcggagcggcgugcugugggacguccccuccccgcccgagacgcagaaggccgagcucgaggaggggguguaccgcaucaagcagcagggcaucuucgggaagacccaggugggcgucggggugcagaaggagggcguguuccacaccauguggcacgucacccggggcgccgugcugacgcacaacgggaagcgccuggagcccaacugggccagcgugaagaaggaccucaucuccuacggcgggggcuggcggcugagcacccaguggcagaagggggaggagguccaggugaucgccguggagcccggcaagaacccgaagaacuuccagaccaugcccggcaucuuccagaccacgaccggggagaucggcgcgaucgcccuggacuucaagcccgggaccuccggcagcccgaucaucaaccgcgagggcaaggucguggggcuguacggcaacgggguggucaccaagaacggcggguacgugagcggcaucgcccagacgaacgccgagcccgacggccccacccccgagcucgaggaggagauguucaagaagcggaaccugaccaucauggaccugcacccgggguccggcaagacccgcaaguaccuccccgcgaucgugcgggaggccaucaagcgccggcugcgcacgcugauccucgcccccacccgggucguggccgccgagauggaggaggcgcugaaggggcugcccauccgcuaccagaccaccgccaccaagagcgagcacaccggccgggagaucguggaccucaugugccacgccaccuucaccaugcgccugcuguccccgguccgggugcccaacuacaaccucaucaucauggacgaggcccacuucacggaccccgccagcaucgcggcccgcggguacaucuccacccgggugggcaugggcgaggccgccgccaucuucaugaccgcgacgccgcccgggacggccgaggccuucccccagagcaacgcccccauccaggacgaggagcgcgacauccccgagcgcuccuggaacagcggcaacgaguggaucaccgacuucgucgggaagaccgugugguucgugcccuccaucaaggcgggcaacgacaucgccaacugccugcggaagaacgggaagaaggucauccagcugagccgcaagaccuucgacacggaguaccagaagacccggcucaacgacugggacuucguggugaccaccgacaucuccgagaugggcgccaacuucaaggccgaccgcgucaucgacccccggcgcugccugaagcccgugauccugacggacggccccgagcgggugauccucgccgggccgaugcccgucaccgcggccagcgccgcccagcgccggggccgcguggggcggaacccccagaaggagaacgaccaguacaucuucaccggccagccccugaacaacgacgaggaccacgcccacuggaccgaggcgaagaugcugcucgacaacaucaacaccccggaggggaucauccccgcccuguucgagcccgagcgcgagaaguccgccgccaucgacggcgaguaccggcugaagggcgagagccgcaagacguucgucgagcucaugcggcgcggggaccugcccguguggcuggcccacaagguggcguccgagggcaucaaguacaccgaccggaaguggugcuucgacggggagcgcaacaaccagauccucgaggagaacauggacgucgagaucuggaccaaggagggcgagcggaagaagcugcgcccgcgcuggcuggacgcccggaccuacagcgacccccucgcccugaaggaguucaaggacuucgccgcgggccgcaaguccaucgcccuggaccucgugacggagaucgggcgggugcccagccaccuggcccaccgcacccggaacgcccuggacaaccucgucaugcugcacaccuccgagcacggcgggcgcgccuaccggcacgcgguggaggagcugccggagaccauggagacgcuccugcugcucggccugaugauccugcucaccgggggcgccaugcuguuccuggugagcggcaaggggaucggcaagaccaccaucgggcucaucugcgucaucgugagcuccggcaugcuguggauggccgacaucccccugcaguggaucgccagcgccaucgugcucgaguucuucaugaugguccugcugauccccgagcccgagaagcagcgcacgccgcaggacaaccagcucgcguacguggugaucgggauccugacccuggccgccaucgucgccgccaacgagaugggccuccuggagaccaccaagcgggaccugggcauguccaaggagcccgggguggugagccccacguccuaccucgacgucgaccugcaccccgcgagcgccuggacccuguacgccguggccaccaccgugaucacgccgaugcuccgccacaccaucgagaacuccaccgccaacgucagccuggcggccaucgccaaccaggccguggugcugaugggccucgacaagggguggcccaucuccaagauggaccugggcgucccccugcucgcgcuggggugcuacagccaggugaacccccugacccucacggccgccgugcugcugcucgucacccacuacgccaucaucggcccgggccugcaggccaaggcgacccgggaggcccagaagcgcaccgccgccgggaucaugaagaaccccacgguggacggcaucaugaccaucgaccuggaccccgugaucuacgacuccaaguucgagaagcagcucgggcaggucaugcugcuggugcucugcgccgugcagcugcugcucaugcggaccagcugggcgcugugcgaggcccugacccucgccacgggccccaucaccacccugugggagggcuccccggggaaguucuggaacaccacgaucgccgucagcauggccaacaucuuccgcggcuccuaccuggcgggggccggccucgccuucagcaucaugaaguccguggggaccggccggcgcggcaccgggagccagggcgagacccugggggagaaguggaagaagaagcugaaccagcucucccggaaggaguucgaccuguacaagaaguccggcaucaccgagguggaccgcacggaggccaaggaggggcugaagcggggcgagaccacccaccacgcggucagccgcggcuccgccaagcuccagugguucguggagcggaacauggugauccccgaggggcgcgucaucgaccugggcugcgggcgcggcggguggagcuacuacugcgccggccugaagaaggugaccgaggugcggggcuacacgaagggcgggcccgggcacgaggagcccgucccgauguccaccuacggcuggaacaucgugaagcucaugagcgggaaggacguguucuaccugccgcccgagaagugcgacacccugcugugcgacaucggcgaguccagccccuccccgaccgucgaggagagccgcacgauccgggugcucaagaugguggagcccuggcugaagaacaaccaguucugcaucaagguccugaaccccuacaugcccaccgugaucgagcaccucgagcgccugcagcggaaguacggcgggaugcuggugcgcaacccgcucucccggaacagcacccacgagauguacuggaucuccaacggcaccgggaacaucgucagcuccgugaacauggucagccgccugcugcucaaccgguucacgaugacccaccgccggcccaccaucgagaaggacguggaccugggcgccggcacccgccacgugaacgccgagcccgagacgccgaacauggacgucaucggggagcggaucaagcgcaucaaggaggagcacuccagcaccuggcacuacgacgacgagaaccccuacaagaccugggcguaccacggcuccuacgaggugaaggccaccgggagcgccuccagcaugaucaacggcguggucaagcugcucacgaagcccugggacguggugcccauggucacccagauggccaugaccgacaccacgccguucgggcagcagcggguguucaaggagaagguggacacccgcacgccccggcccaugcccggcacccgcaaggucauggagaucacggccgaguggcuguggcggacccugggccgcaacaagaagccgcgccucugcacccgggaggaguucaccaagaaggugcgcacgaacgcggccaugggggccguguucaccgaggagaaccagugggacagcgcccgggccgcggucgaggacgaggaguucuggaagcugguggaccgcgagcgggagcugcacaagcucggcaagugcggguccugcguguacaacaugaugggcaagcgcgagaagaagcugggggaguucggcaaggccaagggcagccgggccaucugguacauguggcugggggcccgcuuccucgaguucgaggcgcugggcuuccugaacgaggaccacugguucucccgggagaacagcuacuccggggucgagggcgaggggcuccacaagcugggcuacauccugcgcgacaucagcaagauccccggcggggccauguacgccgacgacaccgccggcugggacacccggaucacggaggacgaccuccacaacgaggagaagaucacccagcagauggaccccgagcaccgccagcuggccaacgcgaucuucaagcugaccuaccagaacaagguggugaagguccagcggcccaccccgaaggggaccgugauggacaucaucucccgcaaggaccagcggggcagcggccagguggggacguacggccucaacaccuucaccaacauggaggcccagcugguccgccagauggagggggagggcgugcuguccaagaccgaccucgagaacccccaccuccuggagaagaagaucacgcaguggcucgagaacaaggggguggagcggcugaagcgcauggccaucagcggcgacgacugcgucgugaagcccaucgacgaccgguucgccaacgcccugcucgcgcugaacgacaugggcaaggugcgcaaggacaucccccaguggcagccguccaagggguggcacgacuggcagcagguccccuucugcagccaccacuuccacgagcugaucaugaaggacggccggaagcucguggugcccugccgcccccaggacgagcugaucgggcgcgcccggaucucccagggcgccggguggagccugaaggagaccgccugccucggcaaggccuacgcgcagauguggucccugauguacuuccaccgccgggaccugcgccucgccagcaacgccaucugcuccgccgucccggugcacugggugcccaccagccggaccacgugguccauccacgcccaccaccaguggaugaccaccgaggacaugcugaccgucuggaaccgcguguggaucgaggacaaccccuggauggaggacaagacgcccgugaccaccugggaggacgucccguaccugggcaagcgggaggaccaguggugcgggagccucaucggccugaccagccgcgcgacgugggcccagaacauccugaccgccauccagcagguccggucccucaucggggacgaggaguuccuggacuacaugcccagcaugaagcgcuuccggaaggaggaggaguccgagggcgccaucugguga

SEQ ID NO: 9964 - RNA, 9873 nt, Artificial Sequence
  derived and/or modified CDS sequence (opt1) from DENV-3__FJ639722__SS-prME
accagccugugccucaugaugaugcugcccgcgacccuggccuuccaccucaccagccgggacggcgagccccggaugaucguggggaagaacgagcgcggcaagagccugcuguucaagaccgcgaccgggaucaacaugugcacccucaucgccauggaccugggcgagaugugcgacgacacggugaccuacaagugcccccugaucgccgagguggagcccgaggacaucgacugcuggugcaaccucaccuccaccugggugacguacgggaccugcaaccaggccggcgagcaccggcgcgacaagcggagcgucgcccuggcgccccacgugggcauggggcuggacacccgcacccagacguggauguccgccgagggcgccuggcgccagguggagaaggucgagaccugggcccuccgccacccgggguucaccauccuggcgcuguuccucgcccacuacaucggcaccagccugauccagaagguggugaucuucauccugcucaugcuggucacgcccuccaugaccaugcggugcgugggggugggcaaccgcgacuucgucgagggccugagcggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacucccgcugccccacgcagggcgaggccauccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccuccaccguggaggccgugcugcccgaguacggcacccucgggcuggagugcagcccgcgcaccggccuggacuucaacgagaugauccuccugaccaugaagaacaaggcguggaugguccaccggcagugguucuucgaccugccccuccccuggacguccggcgccaccaccgagacccccacguggaaccgcaaggagcugcuggugaccuucaagaacgcccacgccaagaagcaggagguggucgugcucgggagccaggagggcgccaugcacaccgcgcugaccggggccacggagauccagaacuccggcgggaccagcaucuucgccggccaccugaagugccggcucaagauggacaagcuggagcugaagggcauguccuacgccaugugccucaacaccuucgugcugaagaaggaggucagcgagacccagcacgggacgauccugaucaagguggaguacaagggcgaggacgccccgugcaagauccccuucuccaccgaggacgggcagggcaaggcgcacaacggccgccugaucaccgccaaccccguggucaccaagaaggaggagcccgugaacaucgaggccgagccgcccuucggggagagcaacaucgugaucggcaucggggagaaggcccucaagaucaacugguacaagaagggcagcuccaucgggaagauguucgaggcgacggcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucaccuggaucggccugaacuccaagaacacgagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacaccuggacggagcaguacaaguuccaggccgacagccccaagcgccuggcgaccgccaucgccggcgccugggagaacggggugugcggcauccgcuccaccacccggauggagaaccuccuguggaagcagaucgccaacgagcugaacuacauccucugggagaacaacaucaagcugacggucguggugggggacaucaucggcguccuggagcagggcaagcgcacccucacgccccagccgauggagcugaaguacagcuggaagaccugggggaaggcgaagaucgugacggccgagacccagaacuccagcuucaucaucgacggccccaacacccccgagugccccuccgccagccgggccuggaacgugugggaggucgaggacuacggguucggcguguucaccacgaacaucuggcugaagcuccgcgagguguacacccaguccugcgaccaccggcugaugagcgcggccaucaaggacgagcgcgccguccacgccgacaugggcuacuggaucgagagccagaagaacggguccuggaagcuggagaaggccagcuucaucgaggugaagaccugcaccuggccgaagucccacacccucuggagcaacggcgugcuggaguccgacaugaucauccccaagagccuggcggggcccaucucccagcacaaccaccggccgggcuaccacacgcagaccgccgggcccuggcaccucggcaagcuggagcuggacuucaacuacugcgagggcaccaccgucgugaucacggagaacugcgggacccgcggccccagccuccggaccaccacgguguccgggaagcugauccacgaguggugcugccgcagcugcacccugcccccgcuccgguacaugggcgaggacgggugcugguacggcauggagauccgccccaucaacgagaaggaggagaacauggucaagucccuggugagcgccggcuccgggaagguggacaacuucaccaugggcguccugugccucgccauccuguucgaggaggugaugcgggggaaguucggcaagaagcacaugaucgccggggugcuguucaccuucguccuccugcugagcggccagaucacguggcgcgacauggcgcacacccucaucaugaucggcuccaacgccagcgaccggauggggaugggcgugaccuaccuggcccugaucgccaccuucaagauccagcccuuccucgcccugggguucuuccugcgcaagcucacgucccgggagaaccugcugcucggcgugggccuggcgauggccaccacccugcagcuccccgaggacaucgagcagauggccaacgggaucgcccugggccugaugacccucaagcugaucacgcaguucgagaccuaccagcuguggaccgcgcucgucagccugaccugcagcaacacgaucuucacccugaccguggccuggcgcaccgccacgcucauccuggccggggucucccugcucccgcugugccagagcuccagcaugcggaagaccgacuggcugcccaugaccguggccgcgaugggcgugccgccccugccgcuguucaucuucucccugaaggacgcccccaagcgccgcagcuggccccucaacgagggggucauggccgugggccugguguccauccuggccagcucccuccugcggaacgacguccccauggccggcccgcugguggccggcgggcuccugaucgccugcuacgugaucaccgggacgagcgccgaccugaccgucgagaaggccgccgacgugaccugggaggaggaggcggagcagaccggggugucccacaaccucaugaucacggucgacgacgacgggaccaugcgcaucaaggacgacgagaccgagaacauccugaccgugcugcucaagaccgcccugcugaucgugagcggcaucuuccccuacuccauccccgccacgcuccuggucuggcacaccuggcagaagcagacccagcggagcggcgugcugugggacgugcccuccccgcccgagacccagaaggccgagcucgaggagggggucuaccgcaucaagcagcagggcaucuucgggaagacccaggugggcguggggguccagaaggagggcguguuccacaccauguggcacgugacccggggcgccguccugacccacaacgggaagcgccuggagcccaacugggcgagcgugaagaaggaccucaucuccuacggcgggggcuggcggcugagcacgcaguggcagaagggggaggaggugcaggucaucgccguggagcccggcaagaacccgaagaacuuccagaccaugcccggcaucuuccagaccaccacgggggagaucggcgccaucgcccuggacuucaagcccgggaccuccggcagcccgaucaucaaccgcgagggcaagguggucgggcuguacggcaacgggguggugaccaagaacggcggguacgucagcggcaucgcgcagaccaacgccgagcccgacggccccacgcccgagcucgaggaggagauguucaagaagcggaaccugaccaucauggaccugcacccgggguccggcaagacccgcaaguaccuccccgccaucgugcgggaggccaucaagcgccggcugcgcacccugauccucgcccccacgcggguggucgcggccgagauggaggaggcccugaaggggcugcccauccgcuaccagaccaccgccaccaagagcgagcacacgggccgggagaucguggaccucaugugccacgccaccuucaccaugcgccugcuguccccggugcggguccccaacuacaaccucaucaucauggacgaggcgcacuucaccgaccccgccagcaucgccgcccgcggguacaucuccacgcgggugggcaugggcgaggccgcggccaucuucaugaccgccacgccgcccgggaccgccgaggcguucccccagagcaacgcccccauccaggacgaggagcgcgacauccccgagcgcuccuggaacagcggcaacgaguggaucacggacuucguggggaagaccgucugguucgugcccuccaucaaggccggcaacgacaucgccaacugccugcggaagaacgggaagaaggugauccagcugagccgcaagaccuucgacaccgaguaccagaagacgcggcucaacgacugggacuucgucgugaccaccgacaucuccgagaugggcgccaacuucaaggcggaccgcgugaucgacccccggcgcugccugaagcccgucauccugaccgacggccccgagcgggugauccucgccgggccgaugcccgugacggccgccagcgccgcgcagcgccggggccgcgucgggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgccgcgaucgacggcgaguaccggcugaagggcgagagccgcaagaccuucguggagcucaugcggcgcggggaccugcccgucuggcuggcccacaagguggccuccgagggcaucaaguacacggaccggaaguggugcuucgacggggagcgcaacaaccagauccucgaggagaacauggacguggagaucuggaccaaggagggcgagcggaagaagcugcgcccgcgcuggcuggacgcccggaccuacagcgacccccucgcgcugaaggaguucaaggacuucgccgccggccgcaaguccaucgcccuggaccucgucaccgagaucgggcgggugcccagccaccuggcccaccgcacgcggaacgcgcuggacaaccucgugaugcugcacaccuccgagcacggcgggcgcgccuaccggcacgccgucgaggagcugccggagaccauggagacccuccugcugcucggccugaugauccugcucaccggcggggccaugcuguuccuggugagcgggaaggggaucggcaagaccaccaucgggcucaucugcgugaucgucagcuccggcaugcuguggauggccgacaucccccugcaguggaucgcgagcgccaucgugcucgaguucuucaugauggugcugcugauccccgagcccgagaagcagcgcaccccgcaggacaaccagcucgccuacgucgugaucgggauccugacgcuggccgccaucguggcggccaacgagaugggccuccuggagaccaccaagcgggaccugggcauguccaaggagcccggggucgugagccccaccuccuaccucgacguggaccugcaccccgccagcgccuggacgcuguacgccgucgcgaccaccgugaucaccccgaugcuccgccacacgaucgagaacuccaccgccaacgugagccuggccgccaucgcgaaccaggccgucgugcugaugggccucgacaagggguggcccaucuccaagauggaccugggcgugccccugcucgcccuggggugcuacagccaggucaacccccugacccucaccgccgccgugcugcugcucgugacgcacuacgcgaucaucggcccgggccugcaggccaaggccacccgggaggcccagaagcgcaccgccgcggggaucaugaagaaccccaccgucgacggcaucaugacgaucgaccuggaccccgugaucuacgacuccaaguucgagaagcagcucggccaggugaugcugcugguccucugcgccgugcagcugcugcucaugcggaccagcugggcccugugcgaggcccugacccucgccaccggccccaucacgacccugugggagggcuccccggggaaguucuggaacaccaccaucgcggugagcauggccaacaucuuccgcggcuccuaccuggccggggccggccucgcguucagcaucaugaaguccgucgggacgggccggcgcggcaccgggagccagggcgagacccugggggagaaguggaagaagaagcugaaccagcucucccggaaggaguucgaccuguacaagaaguccggcaucaccgagguggaccgcaccgaggccaaggaggggcugaagcggggcgagacgacccaccacgccgugagccgcggcuccgccaagcuccagugguucgucgagcggaacauggugauccccgaggggcgcgugaucgaccugggcugcgggcgcggcggguggagcuacuacugcgccggccugaagaaggucaccgaggugcggggcuacaccaagggcggccccgggcacgaggagcccgugccgauguccacguacggcuggaacaucgucaagcucaugagcgggaaggacguguucuaccugccgcccgagaagugcgacacccugcugugcgacaucggcgaguccagccccuccccgaccguggaggagagccgcaccauccggguccucaagaugguggagcccuggcugaagaacaaccaguucugcaucaaggugcugaaccccuacaugcccacggucaucgagcaccucgagcgccugcagcggaaguacggcgggaugcuggugcgcaacccgcucucccggaacagcacccacgagauguacuggaucuccaacggcaccgggaacaucgugagcuccgucaacauggugagccgccugcugcucaaccgguucaccaugacgcaccgccggcccaccaucgagaaggacgucgaccugggcgcgggcacccgccacgugaacgccgagcccgagaccccgaacauggacgugaucggggagcggaucaagcgcaucaaggaggagcacuccagcacguggcacuacgacgacgagaaccccuacaagaccugggccuaccacggcuccuacgaggucaaggccaccgggagcgccuccagcaugaucaacggcguggugaagcugcucaccaagcccugggacgucgugcccauggugacgcagauggcgaugaccgacaccaccccguucgggcagcagcgggucuucaaggagaagguggacacgcgcacgccccggcccaugcccggcacccgcaaggugauggagaucaccgccgaguggcuguggcggacgcugggccgcaacaagaagccgcgccucugcacccgggaggaguucaccaagaagguccgcaccaacgccgccaugggggccguguucacggaggagaaccagugggacagcgcgcgggccgccguggaggacgaggaguucuggaagcuggucgaccgcgagcgggagcugcacaagcucggcaagugcggguccugcguguacaacaugaugggcaagcgcgagaagaagcugggggaguucggcaaggccaagggcagccgggcgaucugguacauguggcugggggcccgcuuccucgaguucgaggcccugggcuuccugaacgaggaccacugguucucccgggagaacagcuacuccgggguggagggcgaggggcuccacaagcugggcuacauccugcgcgacaucagcaagauccccggcggggccauguacgccgacgacaccgcgggcugggacacccggaucaccgaggacgaccuccacaacgaggagaagaucacgcagcagauggaccccgagcaccgccagcuggccaacgccaucuucaagcugaccuaccagaacaaggucgugaaggugcagcggcccaccccgaaggggaccgucauggacaucaucucccgcaaggaccagcggggcagcggccagguggggaccuacggccucaacacguucaccaacauggaggcccagcuggugcgccagauggagggggagggcguccuguccaagaccgaccucgagaacccccaccuccuggagaagaagaucacccaguggcucgagaacaaggggguggagcggcugaagcgcauggccaucagcggcgacgacugcguggucaagcccaucgacgaccgguucgcgaacgcccugcucgcccugaacgacaugggcaaggugcgcaaggacaucccccaguggcagccguccaagggguggcacgacuggcagcagguccccuucugcagccaccacuuccacgagcugaucaugaaggacggccggaagcucgucgugcccugccgcccccaggacgagcugaucgggcgcgcccggaucucccagggcgccggguggagccugaaggagacggcgugccucggcaaggccuacgcccagauguggucccugauguacuuccaccgccgggaccugcgccucgccagcaacgccaucugcuccgcggugccgguccacugggugcccaccagccggaccaccugguccauccacgcccaccaccaguggaugacgaccgaggacaugcugaccguguggaaccgcgucuggaucgaggacaaccccuggauggaggacaagacccccgugacgaccugggaggacgugccguaccugggcaagcgggaggaccaguggugcgggagccucaucggccugaccagccgcgccaccugggcccagaacauccugacggcgauccagcagguccggucccucaucggggacgaggaguuccuggacuacaugcccagcaugaagcgcuuccggaaggaggaggaguccgagggcgccaucugguga

SEQ ID NO: 9965 - RNA, 9873 nt, Artificial Sequence
  derived and/or modified CDS sequence (opt1) from DENV-3__FJ639723__SS-prME
accagccugugccucaugaugaugcugcccgccacccuggccuuccaccucaccagccgggacggcgagccccggaugaucguggggaagaacgagcgcggcaagagccugcuguucaagaccgcgaccgggaucaacaugugcacccucaucgccauggaccugggcgagaugugcgacgacaccgugaccuacaagugcccccugaucgccgagguggagcccgaggacaucgacugcuggugcaaccucaccuccgccugggugaccuacgggaccugcaaccaggccggcgagcaccggcgcgacaagcggagcguggcgcuggcgccccacgugggcauggggcuggacacccgcacccagaccuggauguccgccgagggcgccuggcgccagguggagaaggucgagacgugggcgcuccgccacccgggguucaccauccuggcccuguuccucgcccacuacaucggcaccagccugauccagaagguggugaucuucauccugcucaugcuggucacccccuccaugacgaugcggugcgugggggugggcaaccgcgacuucgucgagggccugagcggggccaccuggguggacgugguccucgagcacggcgggugcgugaccaccauggccaagaacaagcccacgcuggacaucgagcugcagaagaccgaggcgacccagcucgccacccugcggaagcugugcaucgagggcaagaucacgaacaucaccaccgacucccgcugccccacccagggcgaggccauccucccggaggagcaggaccagaacuacgugugcaagcacacguacgucgaccggggguggggcaacgggugcggccuguucgggaagggcagccuggugaccugcgccaaguuccagugccucgagcccaucgagggcaaggugguccaguacgagaaccugaaguacaccgugaucaucaccgugcacacgggggaccagcaccaggucggcaacgacacccagggggugaccgucgagaucacgccccaggccuccacgguggaggcggugcugcccgaguacggcacccucgggcuggagugcagcccgcgcaccggccuggacuucaacgagaugauccuccugaccaugaagaacaaggccuggaugguccaccggcagugguucuucgaccugccccuccccuggaccuccggcgccacgaccgagacccccaccuggaaccgcaaggagcugcuggugacguucaagaacgcccacgccaagaagcaggagguggucgugcucgggagccaggagggcgcgaugcacaccgcccugaccggggccaccgagauccagaacuccggcgggacgagcaucuucgccggccaccugaagugccggcucaagauggacaagcuggagcugaagggcauguccuacgccaugugccucaacaccuucgugcugcgcaaggaggucagcgagacccagcacgggaccauccugaucaagguggaguacaagggcgaggacgcgccgugcaagauccccuucuccacggaggacgggcagggcaaggcccacaacggccggcugaucaccgccaaccccguggucaccaagaaggaggagcccgugaacaucgaggccgagccgcccuucggggagagcaacaucgugaucggcaucggggacaaggcgcucaagaucaacugguacaagaagggcagcuccaucgggaagauguucgaggccaccgcccgcggcgcccggcgcauggccauccugggcgacacggcgugggacuucgggagcgucggcggggugcugaacucccucggcaagauggugcaccagaucuucgggagcgccuacaccgcccuguucuccggcgucagcuggaucaugaagaucggcaucggggugcugcucaccuggaucggccugaacuccaagaacaccagcauguccuucagcugcaucgugaucgggaucaucacgcuguaccucggcgccgucgugcaggccgacauggggugcgugaucaacuggaagggcaaggagcugaagugcggcuccgggaucuucgucaccaacgaggugcacaccuggaccgagcaguacaaguuccaggcggacagccccaagcgccuggccacggccaucgccggcgccugggagaacggggugugcggcauccgguccaccacccgcauggagaaccuccuguggaagcagaucgcgaacgagcugaacuacauccucugggagaacaacaucaagcugaccgucguggugggggacaucaucggcguccuggagcagggcaagcggacgcucacgccccagccgauggagcugaaguacagcuggaagaccugggggaaggccaagaucgugaccgccgagacgcagaacuccagcuucaucaucgacggccccaacacccccgagugccccuccgccagccgcgcguggaacgugugggaggucgaggacuacggguucggcguguucaccaccaacaucuggcugaagcuccgggagguguacacgcaguccugcgaccaccgccugaugagcgccgccaucaaggacgagcgggccguccacgccgacaugggcuacuggaucgagagccagaagaacggguccuggaagcuggagaaggcgagcuucaucgaggugaagaccugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccgucgugaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaccaacgagaaggaggagaacauggucaagucccuggugagcgccggcuccgggaagguggacaacuucaccaugggcguccugugccucgccauccuguucgaggaggugaugcgcgggaaguucggcaagaagcacaugaucgcgggggugcuguucaccuucguccuccugcugagcggccagaucacguggcgggacauggcccacacccucaucaugaucggcuccaacgccagcgaccgcauggggaugggcgugaccuaccuggcccugaucgccaccuucaagauccagcccuuccucgcgcugggguucuuccugcggaagcucacgucccgcgagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgucagccugaccugcagcaacacgaucuucacccugaccguggccuggcggaccgccacgcucauccuggccggggucucccugcucccgcugugccagagcuccagcaugcgcaagaccgacuggcugcccaugaccguggcggccaugggcgugccgccccugccgcuguucaucuucucccugaaggacacccccaagcgccggagcuggccccucaacgagggggucauggccgugggccugguguccauccuggccagcucccuccugcgcaacgacguccccauggccggcccgcugguggccggcgggcuccugaucgccugcuacgugaucacggggaccagcgccgaccugaccgucgagaaggccgccgacgugaccugggaggaggaggcggagcagacgggggugucccacaaccucaugaucaccgucgacgacgacgggaccaugcggaucaaggacgacgagaccgagaacauccugaccgugcugcucaagacggcccugcugaucgugagcggcaucuuccccuacuccauccccgccacccuccuggucuggcacaccuggcagaagcagacccagcgcagcggcgugcugugggacgugcccuccccgcccgagacgcagaaggccgagcucgaggagggggucuaccggaucaagcagcagggcaucuucgggaagacccaggugggcguggggguccagaaggagggcguguuccacaccauguggcacgugacccgcggcgccguccugacgcacaacgggaagcggcuggagcccaacugggcgagcgugaagaaggaccucaucuccuacggcgggggcuggcgccugagcacccaguggcagaagggggaggaggugcaggucaucgccguggagcccggcaagaacccgaagaacuuccagaccaugcccggcaucuuccagaccacgaccggggagaucggcgccaucgcccuggacuucaagcccgggaccuccggcagcccgaucaucaaccgggagggcaagguggucgggcuguacggcaacgggguggugaccaagaacggcggguacgucagcggcaucgcgcagacgaacgccgagcccgacggccccacccccgagcucgaggaggagauguucaagaagcgcaaccugaccaucauggaccugcacccgggguccggcaagacccggaaguaccuccccgccaucgugcgcgaggccaucaagcggcgccugcggacgcugauccucgcccccacccgcguggucgcggccgagauggaggaggcccugaaggggcugcccauccgguaccagaccaccgccaccaagagcgagcacaccggccgcgagaucguggaccucaugugccacgccaccuucaccaugcggcugcuguccccggugcgcguccccaacuacaaccucaucaucauggacgaggcgcacuucacggaccccgccagcaucgccgcccggggguacaucuccacccgcgugggcaugggcgaggccgcggccaucuucaugaccgccacgccgcccgggacggccgaggcguucccccagagcaacgcccccauccaggacgaggagcgcgacauccccgagcgguccuggaacagcggcaacgaguggaucaccgacuucguggggaagaccgucugguucgugcccuccaucaaggccggcaacgacaucgccaacugccugcgcaagaacgggaagaaggugauccagcugagccggaagaccuucgacacggaguaccagaagacccgccucaacgacugggacuucgucgugaccaccgacaucuccgagaugggcgccaacuucaaggcggaccgggugaucgacccccgccggugccugaagcccgucauccugacggacggccccgagcgcgugauccucgccgggccgaugcccgugaccgccgccagcgccgcgcagcggcgcggccgggucgggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgccgcgaucgacggcgaguaccgccugaagggcgagagccggaagacguucguggagcucaugcgccgcggggaccugcccgucuggcuggccuacaagguggccuccgagggcaucaaguacaccgaccgcaaguggugcuucgacggggagcggaacaaccagauccucgaggagaacauggacguggagaucuggaccaaggagggcgagcgcaagaagcugcgcccgcgguggcuggacgcccgcaccuacagcgacccccucgcgcugaaggaguucaaggacuucgccgccggccggaaguccaucgcccuggaccucgucacggagaucgggcgcgugcccagccaccuggcccaccggacccgcaacgcgcuggacaaccucgugaugcugcacaccuccgagcacggcgggcgggccuaccgccacgccgucgaggagcugccggagaccauggagacgcuccugcugcucggccugaugauccugcucaccgggggcgccaugcuguuccugaucagcggcaaggggaucggcaagaccaccaucgggcucaucugcgugaucgugagcuccggcaugcuguggauggccgacaucccccugcaguggaucgcgagcgccaucguccucgaguucuucaugauggugcugcugauccccgagcccgagaagcagcggacgccgcaggacaaccagcucgccuacguggucaucgggauccugacccuggccgccaucguggcggccaacgagaugggccuccuggagaccaccaagcgcgaccugggcauguccaaggagcccgggguggucagccccacguccuaccucgacguggaccugcaccccgccagcgccuggacccuguacgccguggcgaccaccgucaucacgccgaugcuccggcacaccaucgagaacuccaccgccaacgugagccuggccgccaucgcgaaccaggccgugguccugaugggccucgacaagggguggcccaucuccaagauggaccugggcgugccccugcucgcccuggggugcuacagccaggugaacccccugacccucacggccgccguccugcugcucgugacccacuacgcgaucaucggcccgggccugcaggccaaggccacccgcgaggcccagaagcggaccgccgcggggaucaugaagaaccccacgguggacggcaucaugaccaucgaccuggaccccgucaucuacgacuccaaguucgagaagcagcucggccaggugaugcugcuggugcucugcgccguccagcugcugcucaugcgcaccagcugggcccugugcgaggcccugacccucgccacgggccccaucaccacccugugggagggcuccccggggaaguucuggaacaccacgaucgcggugagcauggccaacaucuuccggggcuccuaccuggccggggccggccucgcguucagcaucaugaaguccguggggaccggccgccggggcaccgggagccagggcgagacccugggggagaaguggaagaagaagcugaaccagcucucccgcaaggaguucgaccuguacaagaaguccggcaucaccgaggucgaccggacggaggccaaggaggggcugaagcgcggcgagaccacccaccacgccgugagccggggcuccgccaagcuccagugguucguggagcgcaacauggucauccccgaggggcgcgugaucgaccugggcugcgggcggggcggguggagcuacuacugcgccggccugaagaaggugaccgagguccgcggcuacacgaagggcgggcccgggcacgaggagcccgugccgauguccaccuacggcuggaacaucgugaagcucaugagcgggaaggacgucuucuaccugccgcccgagaagugcgacacccugcugugcgacaucggcgaguccagccccuccccgaccguggaggagagccggacgauccgcgugcucaagauggucgagcccuggcugaagaacaaccaguucugcaucaaggugcugaaccccuacaugcccaccgugaucgagcaccucgagcggcugcagcgcaaguacggcgggaugcugguccggaacccgcucucccgcaacagcacccacgagauguacuggaucuccaacggcaccgggaacaucgugagcuccgugaacauggucagccggcugcugcucaaccgcuucacgaugacccaccggcgccccaccaucgagaaggacguggaccugggcgcgggcacccggcacgucaacgccgagcccgagacgccgaacauggacgugaucggggagcgcaucaagcggaucaaggaggagcacuccagcaccuggcacuacgacgacgagaaccccuacaagaccugggccuaccacggcuccuacgaggugaaggccaccgggagcgccuccagcaugaucaacggcgucgugaagcugcucacgaagcccugggacgugguccccauggugacccagauggcgaugaccgacaccacgccguucgggcagcagcgcguguucaaggagaaggucgacacccggacgccccggcccaugcccggcacccggaaggugauggagaucacggccgaguggcuguggcgcacccugggccgcaacaagaagccgcggcucugcacccgcgaggaguucaccaagaaggugcggacgaacgccgccaugggggccgucuucaccgaggagaaccagugggacagcgcgcgcgccgccguggaggacgaggaguucuggaagcugguggaccgggagcgcgagcugcacaagcucggcaagugcggguccugcgucuacaacaugaugggcaagcgggagaagaagcugggggaguucggcaaggccaagggcagccgcgcgaucugguacauguggcugggggcccgguuccucgaguucgaggcccugggcuuccugaacgaggaccacugguucucccgcgagaacagcuacuccgggguggagggcgaggggcuccacaagcugggcuacauccugcgggacaucagcaagauccccggcggggccauguacgccgacgacaccgcgggcugggacacccgcaucacggaggacgaccuccacaacgaggagaagaucacccagcagauggaccccgagcaccggcagcuggccaacgccaucuucaagcugaccuaccagaacaagguggucaaggugcagcgccccaccccgaaggggaccgugauggacaucaucucccggaaggaccagcgcggcagcggccaggucgggacguacggccucaacaccuucaccaacauggaggcccagcuggugcggcagauggagggggagggcgugcuguccaaggccgaccucgagaacccccaccuccuggagaagaagaucacccaguggcucgagaacaagggggucgagcgccugaagcggauggcgaucagcggcgacgacugcguggugaagcccaucgacgaccgcuucgccaacgcccugcucgcccugaacgacaugggcaagguccggaaggacaucccccaguggcagccguccaagggguggcacgacuggcagcagguccccuucugcagccaccacuuccacgagcugaucaugaaggacggccgcaagcucgugguccccugccgcccccaggacgagcugaucgggcgggcccgcaucucccagggcgcgggguggagccugaaggagacggccugccucggcaaggccuacgcccagauguggucccugauguacuuccaccggcgcgaccugcggcucgccagcaacgcgaucugcuccgccgugccggugcacuggguccccaccagccgcaccaccugguccauccacgcccaccaccaguggaugacgaccgaggacaugcuggccguguggaaccggguguggaucgaggacaaccccuggauggaggacaagacccccgucaccacgugggaggacgugccguaccugggcaagcgcgaggaccaguggugcgggagccucaucggccugaccagccgggcgaccugggcccagaacauccugaccgccauccagcagguccgcucccucaucggggacgaggaguuccuggacuacaugcccagcaugaagcgguuccgcaaggaggaggaguccgagggcgccaucugguga

SEQ ID NO: 9966 - RNA, 9873 nt, Artificial Sequence
  derived and/or modified CDS sequence (opt1) from DENV-3__FJ639724__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcggcagguggagcgcgucgagacgugggcccuccggcacccgggguucaccauccuggcgcuguuccucgcccacuacaucggcaccucccugacccagaagguggugaucuucauccugcucaugcuggucacgcccagcaugaccaugcgcugcgugggggugggcaaccgggacuucgucgagggccuguccggggccaccuggguggacgugguccucgagcacggcgggugcgugaccacgauggccaagagcaagcccacccuggacaucgagcugcagaagaccgaggccacccagcucgcgacgcugcgcaagcugugcaucgagggcaagaucaccaacaucaccaccgacucccggugccccacgcagggcgaggccacccucccggaggagcaggaccagaacuacgugugcaagcacaccuacgucgaccgcggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucaccccccaggccuccaccguggaggccgugcugcccgaguacggcacccucgggcuggagugcagcccgcggaccggccuggacuucaacgagaugauccuccugacgaugaagaacaaggcguggaugguccaccgccagugguucuucgaccugccccuccccuggaccuccggcgccaccaccgagacgcccaccuggaaccggaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccgccucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccggcugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccgcggcgcccggcgcauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacacguggaccgagcaguacaaguuccaggccgacagccccaagcgccuggcgaccgccaucgccggcgccugggagaacggggugugcggcauccgguccaccacgcgcauggagaaccuccuguggaagcagaucgccaacgagcugaacuacauccucugggagaacaacaucaagcugaccgucguggugggggacaucaucggcguccuggagcagggcaagcggacccucaccccccagccgauggagcugaaguacagcuggaagacgugggggaaggcgaagaucgugaccgccgagacccagaacuccagcuucaucaucgacggccccaacacccccgagugccccuccgccagccgcgccuggaacgugugggaggucgaggacuacggguucggcguguucacgaccaacaucuggcugaagcuccgggagguguacacccagagcugcgaccaccgccugauguccgcggccaucaaggacgagcgggccguccacgccgacaugggcuacuggaucgagagccagaagaacggguccuggaagcuggagaaggccagcuucaucgaggugaagaccugcaccuggccgaagucccacacgcucuggagcaacggcgugcuggaguccgacaugaucauccccaagagccuggcggggcccaucucccagcacaaccaccgcccgggcuaccacacccagaccaccgggcccuggcaccucggcaagcuggagcuggacuucaacuacugcgagggcacgaccgucgugaucaccgagaacugcgggacccggggccccagccuccgcacgaccaccguguccgggaagcugauccacgaguggugcugccggagcugcacccugcccccgcuccgcuacaugggcgaggacgggugcugguacggcauggagauccggcccaucaacgagaaggaggagaacauggucaagucccuggugagcgccggcuccgggaagguggacaacuucacgaugggcguccugugccucgccauccuguucgaggaggugaugcgcgggaaguucggcaagaagcacaugaucgccggggugcuguucaccuucguccuccugcugagcggccagaucaccuggcgggacauggcccacacccucaucaugaucggcuccaacgcgagcgaccgcauggggaugggcgugacguaccuggcccugaucgccaccuucaagauccagcccuuccucgcccugggguucuuccugcggaagcucaccagccgcgagaaccugcugcucggcgugggccuggccauggcgaccacgcugcagcuccccgaggacaucgagcagauggccaacgggaucgcccugggccugaugacccucaagcugaucacccaguucgagaccuaccagcuguggacggcccucgucucccugaccugcagcaacaccaucuucacccugacgguggcguggcggaccgccacccucauccuggccggggucucccugcucccgcugugccagagcuccagcaugcgcaagaccgacuggcugcccaugacgguggccgccaugggcgugcccccccucccgcuguucaucuucucccugaaggacacccccaagcgccggagcuggccccucaacgagggggucauggcggugggccugguguccauccuggccagcucccuccugcgcaacgacguccccauggccggcccgcugguggccgggggccuccugaucgccugcuacgugaucaccgggaccagcgcggaccugacggucgagaaggccgccgacgugaccugggaggaggaggccgagcagaccggcgugucccacaaccucaugaucaccgucgacgacgacgggaccaugcggaucaaggacgacgagacggagaacauccugaccgugcugcucaagaccgcccugcugaucgugagcggcaucuuccccuacuccauccccgcgacccuccuggucuggcacacguggcagaagcagacccagcgcagcggcgugcugugggacgugcccuccccgcccgagacccagaaggccgagcucgaggagggggucuaccggaucaagcagcagggcaucuucgggaagacccaggugggcguggggguccagaaggagggcguguuccacacgauguggcacgugacccgcggcgccguccugacccacaacgggaagcggcuggagcccaacugggccagcgugaagaaggaccucaucuccuacggcgggggcuggcgccugagcgcccaguggcagaagggggaggaggugcaggucaucgcgguggagcccggcaagaacccgaagaacuuccagaccaugcccggcaucuuccagacgaccaccggggagaucggcgccaucgcccuggacuucaagcccgggaccagcggcuccccgaucaucaaccgggagggcaagguggucgggcuguacggcaacgggguggugacgaagaacggcggguacgucagcggcaucgcccagaccaacgcggagcccgacggccccacccccgagcucgaggaggagauguucaagaagcgcaaccugaccaucauggaccugcacccgggguccggcaagacgcggaaguaccuccccgccaucgugcgcgaggccaucaagcggcgccugcggacccugauccucgcccccacccgcguggucgccgcggagauggaggaggcccugaaggggcugcccauccgguaccagaccacggccaccaagagcgagcacaccggccgcgagaucguggaccucaugugccacgccaccuucacgaugcggcugcuguccccggugcgcguccccaacuacaaccucgugaucauggacgaggcccacuucaccgaccccgcgagcaucgccgcccggggguacaucuccacccgcgugggcaugggcgaggccgccgcgaucuucaugaccgccacgcccccggggaccgccgaggccuucccccagagcaacgcgcccauccaggacgaggagcgcgacauccccgagcgguccuggaacagcggcaacgaguggaucaccgacuucgucgggaagaccgugugguucgugccguccaucaaggccggcaacgacaucgccaacugccugcgcaagaacgggaagaaggucauccagcugagccggaagacguucgacaccgaguaccagaagacccgccucaacgacugggacuucguggugaccacggacaucuccgagaugggcgccaacuucaaggccgaccgggucaucgacccccgccggugccugaagcccgugauccugaccgacggccccgagcgcgugauccucgcggggccgaugcccgucaccgccgccagcgccgcccagcggcgcggccggguggggcgcaacccccagaaggagaacgaccaguacaucuucaccggccagccccugaacaacgacgaggaccacgcgcacuggaccgaggccaagaugcugcucgacaacaucaacacgccggaggggaucauccccgcccuguucgagcccgagcgggagaaguccgccgccaucgacggcgaguaccgccugaagggcgagagccggaagaccuucgucgagcucaugcgccggggggaccugcccguguggcuggcgcacaagguggccuccgagggcaucaaguacaccgaccgcaaguggugcuucgacggggagcggaacaaccagauccucgaggagaacauggacgucgagaucuggaccaaggagggcgagcgcaagaagcugcgcccgcgguggcuggacgcccgcacguacagcgacccccucgcccugaaggaguucaaggacuucgcggccggccggaaguccaucgcccuggaccucgugaccgagaucgggcgcgugcccagccaccuggcccaccggacccgcaacgcccuggacaaccucgucaugcugcacaccagcgagcacggcgggcgggcguaccgccacgccguggaggagcugccggagacgauggagacccuccugcugcucggccugaugauccugcucaccgggggcgccaugcuguuccugaucuccggcaaggggaucggcaagaccagcaucgggcucaucugcgugaucgucuccagcggcaugcuguggauggccgacgugccccugcaguggaucgccuccgcgaucgugcucgaguucuucaugaugguccugcugauccccgagcccgagaagcagcggacgccgcaggacaaccagcucgccuacguggugaucgggauccugacccuggccgccaucgucgccgcgaacgagaugggccuccuggagaccaccaagcgcgaccugggcaugagcaaggagcccgggguggugucccccacgagcuaccucgacgucgaccugcaccccgccuccgccuggacccuguacgccguggccaccaccgugaucacgccgaugcuccggcacaccaucgagaacagcaccgcgaacgucucccuggccgccaucgccaaccaggcgguggugcugaugggccucgacaagggguggcccaucagcaagauggaccugggcgucccccugcucgcccuggggugcuacucccaggugaacccccugacccucacggccgccgugcugcugcucgucacccacuacgccaucaucggcccgggccugcaggcgaaggccacccgcgaggcccagaagcggaccgccgccgggaucaugaagaaccccacgguggacggcaucaugaccaucgaccuggaccccgugaucuacgacagcaaguucgagaagcagcucgggcaggucaugcugcuggugcucugcgcggugcagcugcugcucaugcgcaccuccugggcccugugcgaggcccugacccucgccacgggccccaucaccacccugugggagggcagcccggggaaguucuggaacaccacgaucgccgucuccauggcgaacaucuuccggggcagcuaccuggccggggccggccucgccuucuccaucaugaagagcguggggaccggccgccggggcaccgggagccagggcgagacccugggggagaaguggaagaagaagcugaaccagcucucccgcaaggaguucgaccuguacaagaagagcggcaucaccgagguggaccggacggaggcgaaggaggggcugaagcgcggcgagaccacccaccacgccgucucccggggcagcgccaagcuccagugguucguggagcgcaacauggugauccccgaggggcgcgucaucgaccugggcugcgggcggggcgggugguccuacuacugcgccggccugaagaaggugaccgaggugcgcggcuacacgaaggggggccccgggcacgaggagcccgucccgaugagcaccuacggcuggaacaucgugaagcucauguccgggaaggacguguucuaccugccccccgagaagugcgacacccugcugugcgacaucggcgagagcucccccagcccgaccgucgaggagucccggacgauccgcgugcucaagaugguggagcccuggcugcggaacaaccaguucugcaucaagguccugaaccccuacaugcccaccgugaucgagcaccucgagcgccugcagcggaaguacggcgggaugcuggugcgcaacccgcucagccggaacuccacccacgagauguacuggaucagcaacggcaccgggaacaucgucuccagcgugaacauggucucccgccugcugcucaaccgguucacgaugacccaccgccggcccaccaucgagaaggacguggaccugggcgccggcacccgccacgugaacgcggagcccgagacgccgaacauggacgucaucggggagcggaucaagcgcaucaaggaggagcacagcuccaccuggcacuacgacgacgagaaccccuacaagaccugggccuaccacggcagcuacgaggugaaggccaccgggagcgccuccagcaugaucaacggcguggucaagcugcucacgaagcccugggacguggugcccauggucacccagauggccaugaccgacaccacgccguucgggcagcagcggguguucaaggagaagguggacacccgcaccccccggcccaugcccggcacccgcaaggucauggagaucacggcggaguggcuguggcgcacccugggccggaacaagaagccgcgccucugcacccgggaggaguucaccaagaaggugcgcacgaacgccgccaugggggccguguucaccgaggagaaccagugggacuccgcccgggcggccgucgaggacgaggaguucuggaagcugguggaccgcgagcgggagcugcacaagcucggcaagugcgggagcugcguguacaacaugaugggcaagcgcgagaagaagcugggggaguucggcaaggccaagggcucccgggccaucugguacauguggcugggggcgcgcuaccucgaguucgaggcccugggcuuccugaacgaggaccacugguucagccgggagaacuccuacagcggggucgagggcgaggggcuccacaagcugggcuacauccugcgcgacaucuccaagauccccggcggggccauguacgccgacgacaccgccggcugggacacccggaucacggaggacgaccuccacaacgaggagaagaucacccagcagauggaccccgagcaccgccagcuggcgaacgccaucuucaagcugaccuaccagaacaagguggugaagguccagcggcccaccccgaaggggaccgugauggacaucaucagccgcaaggaccagcggggcuccggccagguggggacguacggccucaacaccuucaccaacauggaggcccagcugguccgccagauggagggggagggcgugcugagcaaggccgaccucgagaacccccaccugcuggagaagaagaucacccaguggcucgagacgaaggggguggagcggcugaagcgcauggccaucuccggcgacgacugcgucgugaagcccaucgacgaccgguucgcgaacgcccugcucgcccugaacgacaugggcaaggugcgcaaggacaucccccaguggcagccgagcaagggguggcacgacuggcagcagguccccuucugcucccaccacuuccacgagcugaucaugaaggacggccgcaagcucguggugcccugccggccccaggacgagcugaucgggcgcgcccggaucagccagggcgccggguggucccugaaggagaccgcgugccucggcaaggccuacgcccagauguggagccugauguacuuccaccgccgggaccugcgccucgccuccaacgccaucugcagcgcggucccggugcacuggauccccaccagccggaccacgugguccauccacgcccaccaccaguggaugaccaccgaggacaugcugaccguguggaaccgcgucuggaucgaggacaaccccuggauggaggacaagacgcccgugaccaccugggaggacgugccguaccugggcaagcgggaggaccaguggugcgggagccucaucggccugaccucccgcgccacgugggcccagaacauccugaccgcgauccagcagguccggagccucaucggggacgaggaguuccuggacuacaugcccuccaugaagcgcuuccggaaggaggaggagagcgagggcgccaucugguga

SEQ ID NO: 9967 - RNA, 9873 nt, Artificial Sequence
  derived and/or modified CDS sequence (opt1) from DENV-3__FJ639725__SS-prME
accagccugugccucaugaugaugcugcccgccacccuggccuuccaccucaccagccgcgacggggagccccggaugaucguggggaagaacgagcgcggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacacguggaccgagcaguacaaguuccaggccgacagccccaagcgccuggcgaccgccaucgccggcgccugggagaacggggugugcggcauccgcuccaccacgcggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacagcuggaagacgugggggaaggcgaagaucgugaccgccgagacccagaacuccagcuucaucaucgacggccccaacacccccgagugccccuccgccagccgggccuggaacgugugggaggucgaggacuacggguucggcguguucacgaccaacaucuggcugaagcuccgcgagguguacacccagagcugcgaccaccggcugauguccgcggccaucaaggacgagcgcgccguccacgccgacaugggcuacuggaucgagagccagaagaacggguccuggaagcuggagaaggccagcuucaucgaggugaagaccugcaccuggccgaagucccacacgcucuggagcaacggcgugcuggaguccgacaugaucauccccaagagccuggcggggcccaucucccagcacaaccaccggccgggcuaccacacccagaccgccgggcccuggcaccucggcaagcuggagcuggacuucaacuacugcgagggcaccacggucgugaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucaacgagaaggaggagaacauggucaagucccuggugagcgccggcuccgggaagguggacaacuucaccaugggcguccugugccucgccauccuguucgaggaggugaugcgggggaaguucggcaagaagcacaugaucgccggggugcuguucacguucguccuccugcugagcggccagaucaccuggcgcgacauggcgcacacccucaucaugaucggcuccaacgccagcgaccggauggggaugggcgugaccuaccuggcccugaucgccacguucaagauccagcccuuccucgcccugggguucuuccugcgcaagcucaccagccgggagaaccugcugcucggcgugggccuggcgauggccaccacccugcagcuccccgaggacaucgagcagauggccaacgggaucgcccugggccugaugacgcucaagcugaucacccaguucgagaccuaccagcuguggaccgcgcucgucucccugacgugcagcaacaccaucuucacccugaccguggccuggcgcacggccacccucauccuggccggggucucccugcucccgcugugccagagcuccagcaugcggaagaccgacuggcugcccaugaccguggccgcgaugggcgugccgccccugccgcuguucaucuucucccugaaggacacgcccaagcgccgcagcuggccccucaacgagggggucauggccgugggccugguguccauccuggccagcucccuccugcggaacgacguccccauggccggcccgcugguggccgggggccuccugaucgcgugcuacgugaucaccgggaccagcgccgaccugaccgucgagaaggccgccgacgugacgugggaggaggaggccgagcagaccggcgugucccacaaccucaugaucaccgucgacgacgacgggaccaugcgcaucaaggacgacgagaccgagaacauccugacggugcugcucaagaccgcgcugcugaucgugagcggcaucuuccccuacuccauccccgccacccuccuggucuggcacaccuggcagaagcagacgcagcggagcggcgugcugugggacgugcccuccccgcccgagacccagaaggccgagcucgaggagggggucuaccgcaucaagcagcagggcaucuucgggaagacccaggugggcguggggguccagaaggagggcguguuccacaccauguggcacgugacgcggggcgccguccugacccacaacgggaagcgccuggagcccaacugggccagcgugaagaaggaccucaucuccuacggcgggggcuggcggcugagcgcgcaguggcagaagggggaggaggugcaggucaucgccguggagcccggcaagaacccgaagaacuuccagaccaugcccggcaucuuccagaccacgaccggggagaucggcgccaucgcccuggacuucaagcccgggaccagcggcuccccgaucaucaaccgcgagggcaagguggucgggcuguacggcaacgggguggugaccaagaacggcggguacgucagcggcaucgcgcagacgaacgccgagcccgacggccccacccccgagcucgaggaggagauguucaagaagcggaaccugaccaucauggaccugcacccgggguccggcaagacccgcaaguaccuccccgccaucgugcgggaggccaucaagcgccggcugcgcacgcugauccucgcccccacccggguggucgcggccgagauggaggaggcccugaaggggcugcccauccgcuaccagaccaccgccaccaagagcgagcacaccggccgggagaucguggaccucaugugccacgccaccuucaccaugcgccugcuguccccggugcggguccccaacuacaaccucgugaucauggacgaggcgcacuucacggaccccgccagcaucgccgcccgcggguacaucuccacccgggugggcaugggcgaggccgcggccaucuucaugaccgccacgccgcccgggacggccgaggcguucccccagagcaacgcccccauccaggacgaggagcgcgacauccccgagcgcuccuggaacagcggcaacgaguggaucaccgacuucgucgggaagaccgugugguucgugcccuccaucaaggccggcaacgacaucgccaacugccugcggaagaacgggaagaaggucauccagcugagccgcaagaccuucgacacggaguaccagaagacccggcucaacgacugggacuucguggugaccaccgacaucuccgagaugggcgccaacuucaaggcggaccgcgucaucgacccccggcgcugccugaagcccgugauccugacggacggccccgagcgggugauccucgccgggccgaugcccgucaccgccgccagcgccgcgcagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgccgcgaucgacggcgaguaccggcugaagggcgagagccgcaagacguucgucgagcucaugcggcgcggggaccugcccguguggcuggcccacaagguggccuccgagggcaucaaguacaccgaccggaaguggugcuucgacggggagcgcaacaaccagauccucgaggagaacauggacgucgagaucuggaccaaggagggcgagcggaagaagcugcgcccgcgcuggcuggacgcccggaccuacagcgacccccucgcgcugaaggaguucaaggacuucgccgccggccgcaaguccaucgcccuggaccucgugacggagaucgggcgggugcccagccaccuggcccaccgcacccggaacgcgcuggacaaccucgucaugcugcacaccagcgagcacggcgggcgcgccuaccggcacgccguggaggagcugccggagaccauggagacgcuccugcugcucggccugaugauccugcucaccgggggcgccaugcuguuccugaucuccggcaaggggaucggcaagaccagcaucgggcucaucugcgugaucgccuccagcggcaugcuguggauggcggacgucccccugcaguggaucgccuccgccaucgugcucgaguucuucaugauggugcugcugauccccgagcccgagaagcagcgcaccccgcaggacaaccagcucgccuacgucgugaucgggauccugacgcuggccgcgaucguggccgccaacgagaugggccuccuggagaccaccaagcgggaccugggcaugagcaaggagcccggggucgugucccccaccagcuaccucgacguggaccugcaccccgccuccgccuggacgcuguacgcggucgccaccaccgugaucaccccgaugcuccgccacacgaucgagaacagcaccgccaacgugucccuggccgcgaucgccaaccaggccgucgugcugaugggccucgacaagggguggcccaucagcaagauggaccugggcgugccccugcucgcccuggggugcuacucccaggucaacccccugacccucaccgccgcggugcugcugcucgugacgcacuacgccaucaucggcccgggccugcaggccaaggccacccgggaggcccagaagcgcaccgcggccgggaucaugaagaaccccaccgucgacggcaucaugacgaucgaccuggaccccgugaucuacgacagcaaguucgagaagcagcucggccaggugaugcugcugguccucugcgccgugcagcugcugcucaugcggaccuccugggcccugugcgaggcccugacccucgcgaccggccccaucacgacccugugggagggcagcccggggaaguucuggaacaccaccaucgccguguccauggccaacaucuuccgcggcagcuaccuggccggggcgggccucgccuucuccaucaugaaguccgucgggacgggccggcgcggcaccgggagccagggcgagacccugggggagaaguggaagaagaagcugaaccagcucucccggaaggaguucgaccuguacaagaaguccggcaucaccgagguggaccgcaccgaggccaaggaggggcugaagcggggcgagacgacccaccacgccgugucccgcggcagcgccaagcuccagugguucgucgagcggaacauggugauccccgaggggcgcgugaucgaccugggcugcgggcgcggcgggugguccuacuacugcgcgggccugaagaaggucaccgaggugcggggcuacaccaagggcgggcccgggcacgaggagcccgugccgaugagcacguacggcuggaacaucgucaagcucauguccgggaaggacguguucuaccugccgcccgagaagugcgacacccugcugugcgacaucggcgagagcucccccagcccgaccguggaggagucccgcaccauccggguccucaagaugguggagcccuggcugcgcaacaaccaguucugcaucaaggugcugaaccccuacaugcccacggucaucgagcaccucgagcggcugcagcgcaaguacggcgggaugcuggugcggaacccgcucagccgcaacuccacccacgagauguacuggaucagcaacggcaccgggaacaucguguccagcgucaacauggugucccggcugcugcucaaccgcuucaccaugacgcaccggcgccccaccaucgagaaggacgucgaccugggcgccggcacccggcacgugaacgccgagcccgagaccccgaacauggacgugaucggggagcgcaucaagcggaucaaggaggagcacagcuccacguggcacuacgacgacgagaaccccuacaagaccugggccuaccacggcagcuacgaggucaaggccaccgggagcgcguccagcaugaucaacggcguggugaagcugcucaccaagcccugggacgucgugcccauggugacgcagauggccaugaccgacaccaccccguucgggcagcagcgcgucuucaaggagaagguggacacgcggacgccccggcccaugcccggcacccggaaggugauggagaucaccgccgaguggcuguggcgcacgcugggccgcaacaagaagccgcggcucugcacccgcgaggaguucaccaagaagguccggaccaacgccgccaugggggcgguguucacggaggagaaccagugggacuccgcccgcgccgccguggaggacgaggaguucuggaagcuggucgaccgggagcgcgagcugcacaagcucggcaagugcgggagcugcguguacaacaugaugggcaagcgggagaagaagcugggggaguucggcaaggcgaagggcucccgcgccaucugguacauguggcugggggcccgguaccucgaguucgaggcccugggcuuccugaacgaggaccacugguucagccgcgagaacuccuacagcgggguggagggcgaggggcuccacaagcugggcuacauccugcgggacaucuccaagauccccggcggggccauguacgcggacgacaccgccggcugggacacccgcaucaccgaggacgaccuccacaacgaggagaagaucacgcagcagauggaccccgagcaccggcagcuggccaacgccaucuucaagcugaccuaccagaacaaggucgugaaggugcagcgccccaccccgaaggggaccgucauggacaucaucagccggaaggaccagcgcggcuccggccagguggggaccuacggccucaacacguucaccaacauggaggcccagcuggugcggcagauggagggggagggcguccugagcaaggcggaccucgagaacccccaccuccuggggaagaagaucacccaguggcucgagaccaagggcguggagcgccugaagcggauggccaucuccggcgacgacugcguggucaagcccaucgacgaccgcuucgccaacgcccugcucgcccugaacgacauggggaaggugcggaaggacaucccccaguggcagccgagcaagggcuggcacgacuggcagcagguccccuucugcucccaccacuuccacgagcugaucaugaaggacgggcgcaagcucgucgugcccugccgcccccaggacgagcugaucggccgggcgcgcaucagccagggggccggcuggucccugaaggagacggccugccucggcaaggccuacgcccagauguggagccugauguacuuccaccggcgcgaccugcggcucgcguccaacgccaucugcagcgccgugccgguccacuggauccccaccagccgcaccaccugguccauccacgcccaccaccaguggaugacgaccgaggacaugcugaccguguggaaccggguguggaucgaggacaaccccuggauggaggacaagacccccgucacgaccugggaggacgugccguaccuggggaagcgcgaggaccaguggugcggcagccucaucgggcugaccucccgggcgaccugggcccagaacauccugacggccauccagcagguccgcagccucaucggcgacgaggaguuccuggacuacaugcccuccaugaagcgguuccgcaaggaggaggagagcgagggggccaucugguga

SEQ ID NO: 9968 - RNA, 9873 nt, Artificial Sequence
  derived and/or modified CDS sequence (opt1) from DENV-3__FJ639726__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcggcagguggagcgcgucgagacgugggcccuccggcacccgggguucaccauccuggcgcuguuccucgcccacuacaucggcaccucccugacccagaagguggugaucuucauccugcucaugcuggucacgcccagcaugaccaugcgcugcgugggggugggcaaccgggacuucgucgagggccuguccggggccaccuggguggacgugguccucgagcacggcgggugcgugaccacgauggccaagagcaagcccacccuggacaucgagcugcagaagaccgaggccacccagcucgcgacgcugcgcaagcugugcaucgagggcaagaucaccaacaucaccaccgacucccggugccccacgcagggcgaggccacccucccggaggagcaggaccagaacuacgugugcaagcacaccuacgucgaccgcggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucaccccccaggccuccaccguggaggccgugcugcccgaguacggcacccucgggcuggagugcagcccgcggaccggccuggacuucaacgagaugauccuccugacgaugaagaacaaggcguggaugguccaccgccagugguucuucgaccugccccuccccuggaccuccggcgccaccaccgagacgcccaccuggaaccggaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccgccucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccggcugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccgcggcgcccggcgcauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacacguggaccgagcaguacaaguuccaggccgacagccccaagcgccuggcgaccgccaucgccggcgccugggagaacggggugugcggcauccgguccaccacgcgcauggagaaccuccuguggaagcagaucgccaacgagcugaacuacauccucugggagaacaacaucaagcugaccgucguggugggggacaucaucggcguccuggagcagggcaagcggacccucaccccccagccgauggagcugaaguacagcuggaagacgugggggaaggcgaagaucgugaccgccgagacccagaacuccagcuucaucaucgacggccccaacacccccgagugccccuccgccagccgcgccuggaacgugugggaggucgaggacuacggguucggcguguucacgaccaacaucuggcugaagcuccgggagguguacacccagagcugcgaccaccgccugauguccgcggccaucaaggacgagcgggccguccacgccgacaugggcuacuggaucgagagccagaagaacggguccuggaagcuggagaaggccagcuucaucgaggugaagaccugcaccuggccgaagucccacacgcucuggagcaacggcgugcuggaguccgacaugaucauccccaagagccuggcggggcccaucucccagcacaaccaccgcccgggcuaccacacccagaccgccgggcccuggcaccucggcaagcuggagcuggacuucaacuacugcgagggcaccacggucgugaucaccgagaacugcgggacccggggccccagccuccgcaccacgaccguguccgggaagcugauccacgaguggugcugccggagcugcacccugcccccgcuccgcuacaugggcgaggacgggugcugguacggcauggagauccggcccaucaacgagaaggaggagaacauggucaagucccuggugagcgccggcuccgggaagguggacaacuucaccaugggcguccugugccucgccauccuguucgaggaggugaugcgcgggaaguucggcaagaagcacaugaucgccggggugcuguucacguucguccuccugcugagcggccagaucaccuggcgggacauggcgcacacccucaucaugaucggcuccaacgccagcgaccgcauggggaugggcgugaccuaccuggcccugaucgccacguucaagauccagcccuuccucgcccugggguucuuccugcggaagcucaccagccgcgagaaccugcugcucggcgugggccuggcgauggccaccacccugcagcuccccgaggacaucgagcagauggccaacgggaucgcccugggccugaugacgcucaagcugaucacccaguucgagaccuaccagcuguggaccgcgcucgucucccugacgugcagcaacaccaucuucacccugaccguggccuggcggacggccacccucauccuggccggggucucccugcucccgcugugccagagcuccagcaugcgcaagaccgacuggcugcccaugaccguggccgcgaugggcgugcccccccucccgcuguucaucuucucccugaaggacacgcccaagcgccggagcuggccccucaacgagggggucauggccgugggccugguguccauccuggccagcucccuccugcgcaacgacguccccauggccggcccgcugguggccgggggccuccugaucgcgugcuacgugaucaccgggaccagcgccgaccugaccgucgagaaggccgccgacgugacgugggaggaggaggccgagcagaccggcgugucccacaaccucaugaucaccgucgacgacgacgggaccaugcggaucaaggacgacgagaccgagaacauccugacggugcugcucaagaccgcgcugcugaucgugagcggcaucuuccccuacuccauccccgccacccuccuggucuggcacaccuggcagaagcagacgcagcgcagcggcgugcugugggacgugcccuccccgcccgagacccagaaggccgagcucgaggagggggucuaccggaucaagcagcagggcaucuucgggaagacccaggugggcguggggguccagaaggagggcguguuccacaccauguggcacgugacgcgcggcgccguccugacccacaacgggaagcggcuggagcccaacugggccagcgugaagaaggaccucaucuccuacggcgggggcuggcgccugagcgcgcaguggcagaagggggaggaggugcaggucaucgccguggagcccggcaagaacccgaagaacuuccagaccaugcccggcaucuuccagaccacgaccggggagaucggcgccaucgcccuggacuucaagcccgggaccagcggcuccccgaucaucaaccgggagggcaagguggucgggcuguacggcaacgggguggugaccaagaacggcggguacgucagcggcaucgcgcagacgaacgccgagcccgacggccccacccccgagcucgaggaggagauguucaagaagcgcaaccugaccaucauggaccugcacccgggguccggcaagacccggaaguaccuccccgccaucgugcgcgaggccaucaagcggcgccugcggacgcugauccucgcccccacccgcguggucgcggccgagauggaggaggcccugaaggggcugcccauccgguaccagaccaccgccacgaagagcgagcacaccggccgcgagaucguggaccucaugugccacgccaccuucaccaugcggcugcuguccccggugcgcguccccaacuacaaccucgugaucauggacgaggcgcacuucacggaccccgccagcaucgccgcccggggguacaucuccacccgcgugggcaugggcgaggccgcggccaucuucaugaccgccacccccccggggacggccgaggcguucccccagagcaacgcccccauccaggacgaggagcgcgacauccccgagcgguccuggaacagcggcaacgaguggaucaccgacuucgucgggaagaccgugugguucgugccguccaucaaggccggcaacgacaucgccaacugccugcgcaagaacgggaagaaggucauccagcugagccggaagaccuucgacacggaguaccagaagacccgccucaacgacugggacuucguggugaccaccgacaucuccgagaugggcgccaacuucaaggcggaccgggucaucgacccccgccggugccugaagcccgugauccugacggacggccccgagcgcgugauccucgccgggccgaugcccgucaccgccgccagcgccgcgcagcggcgcggccggguggggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgccgcgaucgacggcgaguaccgccugaagggcgagagccggaagacguucgucgagcucaugcgccggggggaccugcccguguggcuggcccacaagguggccuccgagggcaucaaguacaccgaccgcaaguggugcuucgacggggagcggaacaaccagauccucgaggagaacauggacgucgagaucuggaccaaggagggcgagcgcaagaagcugcgcccgcgguggcuggacgcccgcaccuacagcgacccccucgcgcugaaggaguucaaggacuucgccgccggccggaaguccaucgcccuggaccucgugacggagaucgggcgcgugcccagccaccuggcccaccggacccgcaacgcgcuggacaaccucgucaugcugcacaccagcgagcacggcgggcgggccuaccgccacgccguggaggagcugccggagaccauggagacgcuccugcugcucggccugaugauccugcucaccgggggcgccaugcuguuccugaucuccggcaaggggaucggcaagaccagcaucgggcucaucugcgugaucgucuccagcggcaugcuguggauggccgacgugccccugcaguggaucgcguccgccaucgugcucgaguucuucaugaugguccugcugauccccgagcccgagaagcagcggaccccgcaggacaaccagcucgccuacguggugaucgggauccugacgcuggccgccaucgucgcggccaacgagaugggccuccuggagaccaccaagcgcgaccugggcaugagcaaggagcccgggguggugucccccaccagcuaccucgacgucgaccugcaccccgccuccgccuggacgcuguacgccguggcgaccaccgugaucaccccgaugcuccggcacacgaucgagaacagcaccgccaacgucucccuggccgccaucgcgaaccaggccguggugcugaugggccucgacaagggguggcccaucagcaagauggaccugggcgucccccugcucgcccuggggugcuacucccaggugaacccccugacccucaccgccgccgugcugcugcucgucacgcacuacgcgaucaucggcccgggccugcaggccaaggccacccgcgaggcccagaagcggaccgccgcggggaucaugaagaaccccaccguggacggcaucaugacgaucgaccuggaccccgugaucuacgacagcaaguucgagaagcagcucgggcaggucaugcugcuggugcucugcgccgugcagcugcugcucaugcgcaccuccugggcccugugcgaggcccugacccucgccaccggccccaucacgacccugugggagggcagcccggggaaguucuggaacaccaccaucgcggucuccauggccaacaucuuccggggcagcuaccuggccggggccggccucgcguucuccaucaugaagagcguggggacgggccgccggggcaccgggagccagggcgagacccugggggagaaguggaagaagaagcugaaccagcucucccgcaaggaguucgaccuguacaagaagagcggcaucaccgagguggaccggaccgaggccaaggaggggcugaagcgcggcgagacgacccaccacgccgucucccggggcagcgccaagcuccagugguucguggagcgcaacauggugauccccgaggggcgcgucaucgaccugggcugcgggcggggcgggugguccuacuacugcgccggccugaagaaggugaccgaggugcgcggcuacaccaaggggggccccgggcacgaggagcccgucccgaugagcacguacggcuggaacaucgugaagcucauguccgggaaggacguguucuaccugagccccgagaagugcgacacccugcugugcgacaucggcgaguccagccccucccccaccgucgaggagagccggaccauccgcgugcucaagaugguggagccguggcugcggaacaaccaguucugcaucaagguccugaaccccuacaugcccacggugaucgagcaccucgagcgccugcagcggaaguacggcgggaugcuggugcgcaacccccucucccggaacagcacccacgagauguacuggaucuccaacggcaccgggaacaucgucagcuccgugaacauggucagccgccugcugcucaaccgguucaccaugacgcaccgccggccgaccaucgagaaggacguggaccugggcgcgggcacccgccacgugaacgccgagcccgagacccccaacauggacgucaucggggagcggaucaagcgcaucaaggaggagcacuccagcacguggcacuacgacgacgagaacccguacaagaccugggccuaccacggcagcuacgaggugaaggccaccggguccgccagcuccaugaucaacggcguggucaagcugcucaccaagcccugggacguggugcccauggucacgcagauggcgaugaccgacaccacccccuucgggcagcagcggguguucaaggagaagguggacacgcgcaccccgcggcccaugcccggcacccgcaaggucauggagaucaccgccgaguggcuguggcgcacgcugggccggaacaagaagccccgccucugcacccgggaggaguucaccaagaaggugcgcaccaacgccgccaugggggccguguucacggaggagaaccagugggacagcgcgcgggccgccgucgaggacgaggaguucuggaagcugguggaccgcgagcgggagcugcacaagcucggcaagugcggguccugcguguacaacaugaugggcaagcgcgagaagaagcugggggaguucggcaaggccaagggcagccgggcgaucugguacauguggcugggggcccgcuaccucgaguucgaggcccugggcuuccugaacgaggaccacugguucucccgggagaacagcuacuccggggucgagggcgaggggcuccacaagcugggcuacauccugcgcgacaucagcaagaucccgggcggggccauguacgccgacgacaccgcgggcugggacacccggaucaccgaggacgaccuccacaacgaggagaagaucacgcagcagauggaccccgagcaccgccagcuggccaacgccaucuucaagcugaccuaccagaacaagguggugaagguccagcggcccacccccaaggggaccgugauggacaucaucucccgcaaggaccagcggggcagcggccagguggggaccuacggccucaacacguucaccaacauggaggcccagcugguccgccagauggagggggagggcgugcuguccaaggccgaccucgagaacccgcaccugcuggagaagaagaucacccaguggcucgagaccaaggggguggagcggcugaagcgcauggcgaucagcggcgacgacugcgucgugaagcccaucgacgaccgguucgccaacgcccugcucgcccugaacgacaugggcaaggugcgcaaggacaucccccaguggcagcccuccaagggguggcacgacuggcagcaggucccguucugcagccaccacuuccacgagcugaucaugaaggacggccgcaagcucguggugcccugccggccccaggacgagcugaucgggcgcgcccggaucucccagggcgcgggguggagccugaaggagacggccugccucggcaaggccuacgcccagauguggucccugauguacuuccaccgccgggaccugcgccucgccagcaacgcgaucugcagcgccguccccgugcacuggaucccgaccucccggaccaccuggagcauccacgcccaccaccaguggaugacgaccgaggacaugcugaccguguggaaccgcgucuggaucgaggacaaccccuggauggaggacaagacccccgugacgaccugggaggacgugcccuaccugggcaagcgggaggaccaguggugcgggucccucaucggccugaccagccgcgccaccugggcgcagaacauccugacggccauccagcagguccggucccucaucggggacgaggaguuccuggacuacaugccgagcaugaagcgcuuccggaaggaggaggaguccgagggcgccaucugguga

SEQ ID NO: 9969 - RNA, 9873 nt, Artificial Sequence
  derived and/or modified CDS sequence (opt1) from DENV-3__KF955333__SS-prME
accagccugugccucaugaugaugcugcccgccacccuggccuuccaccucaccucccgcgacggggagccccggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcggcaggucgagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgccaucaacuggaagggcaaggagcugaagugcggcuccgggaucuucgugaccaacgagguccacacguggaccgagcaguacaaguuccaggcggacagccccaagcgccuggccaccgccaucgccggcgccugggagaacggggugugcggcauccgcuccaccacgcggauggagaaccuccuguggaagcagaucgcgaacgagcugaacuacauccucugggagaacaacaucaagcugaccguggucgugggggacaucaucggcgugcuggagcagggcaagcgcacccucacgccccagccgauggagcugaaguacagcuggaagacgugggggaaggccaagaucgucaccgccgagacccagaacuccagcuucaucaucgacggccccaacacccccgagugccccuccgccagccgggcguggaacgugugggagguggaggacuacggguucggcgucuucacgaccaacaucuggcugaagcuccgcgagguguacacccagagcugcgaccaccggcugauguccgccgccaucaaggacgagcgcgccgcccacgcggacaugggcuacuggaucgagagccagaagaacggguccuggaagcuggagaaggccagcuucaucgaggugaagaccugcaccuggccgaagucccacacgcucuggagcaacggcguccuggaguccgacaugaucauccccaagagccuggccgggcccaucucccagcacaaccaccggccgggcuaccacacccagaccgccgggcccuggcaccucggcaagcuggagcuggacuucaacuacugcgagggcaccacgguggugaucaccgagaacugcgggacccgcggccccagccuccggaccacgaccgucuccgggaagcugauccacgaguggugcugccgcagcugcacccugcccccgcuccgguacaugggcgaggacgggugcugguacggcauggagauccgccccaucaacgagaaggaggagaacauggugaagucccuggugagcgccggcuccgggaaggucgacaacuucaccaugggcgugcugugccucgcgauccuguucgaggaggugaugcgggggaaguucggcaagaagcacaugaucgccgggguccuguucacguucgugcuccugcugagcggccagaucaccuggcgcgacauggcccacacccucaucaugaucggcuccaacgccagcgaccggauggggaugggcgugaccuaccuggcccugaucgcgacguucaagauccagcccuuccucgcccugggguucuuccugcgcaagcucaccagccgggagaaccugcugcucggcgucggccuggccauggccaccacccugcagcuccccgaggacaucgagcagauggcgaacgggaucgcccugggccugaugacgcucaagcugaucacccaguucgagaccuaccagcuguggaccgcccucgugucccugacgugcagcaacaccaucuucacccugaccguggccuggcgcacggccacccucauccuggcgggggucucccugcucccgcugugccagagcuccagcaugcggaagaccgacuggcugcccaugaccguggccgccaugggcgugccgccccugccgcuguucaucuucucccugaaggacacgcccaagcgccgcagcuggccccucaacgagggggugauggccgugggccuggucuccauccuggccagcucccuccugcggaacgacgugcccauggcgggcccgcugguggccgggggccuccugaucgccugcuacgucaucaccgggaccagcgccgaccugaccguggagaagcccgccgacgugcccugggaggaggaggcggagcagacgggcgucucccacaaccucaugaucaccguggacgacgacgggcccaugcgcaucaaggacgacgagaccgagaacauccugaccgugcugcucaagaccgcccugcugaucgucagcggcaucuucccguacuccauccccgccacgcuccugguguggcacaccuggcagaagcagacccagcggagcggcgugcugugggacguccccagcccgcccgagacccagaaggccgagcucgaggaggggguguaccgcaucaagcagcagggcaucuucgggaagacccaggugggcgucggggugcagaaggagggcguguuccacaccauguggcacgucacccggggcgccgugcugacccacaacgggaagcgccuggagcccaacugggcgagcgugaagaaggaccucaucuccuacggcgggggcuggcggcugaacgcccaguggcagaagggggaggagguccaggugaucgccguggagcccggcaagaaccccaagaacuuccagacgaugcccggcaucuuccagaccaccaccggggagaucggcgccaucgcgcuggacuucaagcccgggacgagcggcagccccaucaucaaccgcgagggcaaggucguggggcuguacggcaacgggguggucaccaagaacggcggguacguguccggcaucgcccagaccaacgccgagccggacggccccacccccgagcucgaggaggagauguucaagaagcggaaccugacgaucauggaccugcaccccgggagcggcaagacccgcaaguaccucccggccaucgugcgggaggccaucaagcgccggcugcgcacccugauccucgcgcccacccgggucguggccgccgagauggaggaggcccugaaggggcugcccauccgcuaccagacgaccgccaccaaguccgagcacaccggccgggagaucguggaccucaugugccacgcgacguucaccaugcgccugcugagccccguccgggugccgaacuacaaccucgugaucauggacgaggcccacuucaccgaccccgccuccaucgccgcccgcggguacaucagcacccgggucggcaugggcgaggcggccgccaucuucaugacggccacgccgcccgggaccgcggaggccuucccgcaguccaacgcccccauccaggacgaggagcgcgacauccccgagcgcagcuggaacuccggcaacgaguggaucaccgacuucguggggaagacggugugguucguccccagcaucaaggccggcaacgacaucgccaacugccugcggaagaacgggaagaaggugauccagcugucccgcaagaccuucgacaccgaguaccagaagacccggcucaacgacugggacuucguggucacgaccgacaucagcgagaugggcgcgaacuucaaggccgaccgcgugaucgacccgcggcgcugccugaagcccgugauccugaccgacggccccgagcgggucauccucgccgggcccaugccggugaccgccgccuccgcggcccagcgccggggccgcguggggcggaacccccagaaggagaacgaccaguacaucuucacgggccagccccugaacaacgacgaggaccacgcccacuggaccgaggccaagaugcugcucgacaacaucaacacccccgaggggaucaucccggcccuguucgagcccgagcgcgagaaguccgcggccaucgacggcgaguaccggcugaagggcgagucccgcaagaccuucgucgagcucaugcggcgcggggaccugcccguguggcuggcccacaaggucgccagcgagggcaucaaguacaccgaccggaaguggugcuucgacggggagcgcaacaaccagauccucgaggagaacauggacguggagaucuggacgaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcggguccccucccaccuggcgcaccgcacccggaacgcccuggacaaccucgugaugcugcacacgagcgagcacggcgggcgcgccuaccggcacgccguggaggagcugcccgagaccauggagacccuccugcugcucggccugaugauccugcucaccgggggcgccaugcuguuccugaucagcggcaaggggaucggcaagacguccaucgggcucaucugcgucaucgugagcuccggcaugcuguggauggcggacgugccgcugcaguggaucgccagcgccaucguccucgaguucuucaugauggugcugcugauccccgagcccgagaagcagcgcacgccccaggacaaccagcucgccuacguggucaucgggauccugacccuggccgcgaucguggccgccaacgagaugggccuccuggagaccacgaagcgggaccugggcauguccaaggagccggggguggucagccccaccuccuaccucgacguggaccugcaccccgccagcgccuggacccuguacgcgguggccaccacggucaucacccccaugcuccgccacaccaucgagaacuccaccgccaacgugagccuggccgcgaucgccaaccaggccgugguccugaugggccucgacaagggguggccgaucuccaagauggaccugggcgugccccugcucgcccuggggugcuacagccaggugaacccccugacgcucaccgccgcgguccugcugcucgugacccacuacgccaucaucggccccggccugcaggccaaggccacccgggaggcccagaagcgcacggcggccgggaucaugaagaacccgaccguggacggcaucaugaccaucgaccuggaccccgucaucuacgacuccaaguucgagaagcagcucggccaggugaugcugcuggugcucugcgccguccagcugcugcucaugcggaccagcugggcccugugcgaggcccugacgcucgcgaccggccccaucaccacccugugggagggcucccccgggaaguucuggaacacgaccaucgccgugagcauggccaacaucuuccgcggcuccuaccuggccggggcgggccucgccuucagcaucaugaaguccguggggaccggccggcgcggcaccgggagccagggcgagacgcugggggagaaguggaagaagaagcugaaccagcucagccggaaggaguucgaccuguacaagaaguccggcaucaccgaggucgaccgcaccgaggccaaggaggggcugaagcggggcgagaccacccaccacgccgugagccgcggcuccgccaagcuccagugguucguggagcggaacauggucaucccggaggggcgcgugaucgaccugggcugcgggcgcggcggguggagcuacuacugcgcgggccugaagaaggugacggagguccggggcuacaccaagggcgggcccgggcacgaggagcccgugcccauguccaccuacggcuggaacaucgugaagcucaugagcgggaaggacgucuucuaccugccgcccgagaagugcgacacccugcugugcgacaucggcgaguccagccccucccccacgguggaggagagccgcaccauccgggugcucaagauggucgagccguggcugcgcaacaaccaguucugcaucaaggugcugaaccccuacaugcccaccgugaucgagcaccucgagcggcugcagcgcaaguacggcgggaugcugguccggaacccgcucucccgcaacagcacccacgagauguacuggaucuccaacggcacggggaacaucgugagcuccgugaacauggucagccggcugcugcucaaccgcuucaccaugacccaccggcgccccaccaucgagaaggacguggaccugggcgccggcacgcggcacgucaacgccgagcccgagacccccaacauggacgugaucggggagcgcaucaagcggaucaaggaggagcacuccagcaccuggcacuacgacgacgagaacccguacaagaccugggccuaccacggcuccuacgaggugaaggccacggggagcgcgagcuccaugaucaacggcgucgugaagcugcucaccaagcccugggacgugguccccauggugacccagauggccaugaccgacacgacccccuucgggcagcagcgcguguucaaggagaaggucgacacccggaccccgcgccccaugcccggcacgcggaaggugauggagaucaccgccgaguggcuguggcgcacccugggccgcaacaagaagccccggcucugcacccgcgaggaguucacgaagaaggugcggaccaacgccgccaugggggcggucuucaccgaggagaaccagugggacagcgcccgcgccgccguggaggacgaggaguucuggaagcugguggaccgggagcgcgagcugcacaagcucggcaagugcggguccugcgucuacaacaugaugggcaagcgggagaagaagcugggggaguucggcaaggcgaagggcagccgcgccaucugguacauguggcugggggcccgguaccucgaguucgaggcccugggcuuccugaacgaggaccacugguucucccgcgagaacagcuacuccgggguggagggcgaggggcuccacaagcugggcuacauccugcgggacaucagcaagaucccgggcggggccauguacgcggacgacaccgccggcugggacacgcgcaucaccgaggacgaccuccacaacgaggagaagaucaccgcccagauggaccccgagcaccggcagcuggccaacgccaucuucaagcugaccuaccagaacaagguggucaaggugcagcgccccacgcccaaggggaccgugauggacaucaucucccggaaggaccagcgcggcagcggccaggucgggaccuacggccucaacaccuucaccaacauggaggcgcagcuggugcggcagauggagggggagggcgugcuguccaaggccgaccucgagaacccgcaccuccuggagaagaagaucacgcaguggcucgagaccaagggggucgagcgccugaagcggauggccaucagcggcgacgacugcguggugaagcccaucgacgaccgcuucgccaacgcccugcucgcgcugaacgacaugggcaagguccggaaggacaucccccaguggcagcccuccaagggguggcacgacuggcagcaggucccguucugcagccaccacuuccacgagcugaucaugaaggacggccgcaagcucgugguccccugccgcccccaggacgagcugaucgggcgggcccgcaucucccagggcgccggguggagccugaaggagaccgccugccucggcaaggccuacgcgcagauguggucccugauguacuuccaccggcgcgaccugcggcucgccagcaacgccaucugcuccgccgugcccgugcacuggaucccgaccagccgcacgaccuggagcauccacgcgcaccaccaguggaugaccaccgaggacaugcugacggucuggaaccggguguggaucgaggacaaccccuggauggaggacaagacccccgugaccaccugggaggacgucccguaccugggcaagcgcgaggaccaguggugcgggucccucaucggccugacgagccgggccaccugggcccagaacauccugaccgccauccagcagguccgcucccucaucggggacgaggaguuccuggacuacaugcccagcaugaagcgguuccgcaaggaggaggaguccgagggcgccaucugguga

SEQ ID NO: 9970 - RNA, 9873 nt, Artificial Sequence
  derived and/or modified CDS sequence (opt1) from DENV-3__GQ868628__SS-prME
accagccugugccucaugaugaugcugcccgcgacccuggccuuccaccucaccagccgggacggcgagccccggaugaucguggggaagaacgagcgcggcaagagccugcuguucaagaccgcgagcgggaucaacaugugcacccucaucgccauggaccugggcgagaugugcgacgacaccgucaccuacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacacguggaccgagcaguacaaguuccaggccgacagccccaagcgccuggcgaccgccaucgccggcgccugggagaacggggugugcggcauccgcuccaccacgcggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacagcuggaagacgugggggaaggcgaagaucgugaccgccgagacccagaacuccagcuucaucaucgacggccccaacacccccgagugccccuccgccagccgggccuggaacgugugggaggucgaggacuacggguucggcguguucacgaccaacaucuggcugaagcuccgcgagguguacacccagagcugcgaccaccggcugauguccgcggccaucaaggacgagcgcgccguccacgccgacaugggcuacuggaucgagagccagaagaacggguccuggaagcuggagaaggccagcuucaucgaggugaagaccugcgcguggccgaagucccacacccucuggagcaacggcgugcuggaguccgacaugaucauccccaagagccuggccgggcccaucucccagcacaaccaccggccgggcuaccacacgcagaccgccgggcccuggcaccucggcaagcuggagcuggacuucaacuacugcgagggcaccaccgucgugaucacggagaacugcgggacccgcggccccagccuccggaccaccacgguguccgggaagcugauccacgaguggugcugccgcagcugcacccugcccccgcuccgguacaugggcgaggacgggugcugguacggcauggagauccgccccaucaacgagaaggaggagaacauggucaagucccuggugagcgccggcuccgggaagguggacaacuucaccaugggcguccugugccucgccauccuguucgaggaggugaugcgggggaaguucggcaagaagcacaugaucgcgggggugcuguucaccuucguccuccugcugagcggccagaucacguggcgcgacauggcccacacccucaucaugaucggcuccaacgccagcgaccggauggggaugggcgugaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgucucccugaccugcagcaacacgaucuucacccugaccguggccuggcgcaccgccacgcucauccuggccggggucucccugcucccgcugugccagagcuccagcaugcggaagaccgacuggcugcccaugaccguggcggccaugggcgugccgccccugccgcuguucaucuucucccugaaggacacccccaagcgccgcagcuggccccucaacgagggggucauggccgugggccugguguccauccuggccagcucccuccugcggaacgacguccccauggccggcccgcugguggccggcgggcuccugaucgccugcuacgugaucacggggaccagcgccgaccugaccgucgagaaggccgccgacgugaccugggaggaggaggcggagcagacgggggugucccacaaccucaugaucaccgucgacgacgacgggaccaugcgcaucaaggacgacgagaccgagaacauccugaccgugcugcucaagacggcccugcugaucgugagcggcaucuuccccuacuccauccccgccacccuccuggucuggcacaccuggcagaagcagacccagcggagcggcgugcugugggacgugcccuccccgcccgagacgcagaaggccgagcucgaggagggggucuaccgcaucaagcagcagggcaucuucgggaagacccaggugggcguggggguccagaaggagggcguguuccacaccauguggcacgugacccggggcgccguccugacgcacaacgggaagcgccuggagcccaacugggcgagcgugaagaaggaccucaucuccuacggcgggggcuggcggcugagcgcccaguggcagaagggggaggaggugcaggucaucgccguggagcccggcaagaacccgaagaacuuccagaccaugcccggcaucuuccagaccaccacgggggagaucggcgccaucgcgcuggacuucaagcccgggaccagcggcuccccgaucaucaaccgcgagggcaagguggucgggcuguacggcaacgggguggugaccaagaacggcggguacgucagcggcaucgcccagaccaacgccgagcccgacggccccacgcccgagcucgaggaggagauguucaagaagcggaaccugaccaucauggaccugcacccgggguccggcaagacccgcaaguaccuccccgccaucgugcgggaggccaucaagcgccggcugcgcacccugauccucgcgcccacgcggguggucgccgccgagauggaggaggcccugaaggggcugcccauccgcuaccagaccaccgccaccaagagcgagcacacgggccgggagaucguggaccucaugugccacgcgaccuucaccaugcgccugcuguccccggugcggguccccaacuacaaccucgugaucauggacgaggcccacuucaccgaccccgccagcaucgccgcccgcggguacaucuccacgcgggugggcaugggcgaggcggccgccaucuucaugaccgccacgccgcccgggaccgcggaggccuucccccagagcaacgcccccauccaggacgaggagcgcgacauccccgagcgcuccuggaacagcggcaacgaguggaucacggacuucgucgggaagaccgugugguucgugcccuccaucaaggccggcaacgacaucgccaacugccugcggaagaacgggaagaaggucauccagcugagccgcaagaccuucgacaccgaguaccagaagacgcggcucaacgacugggacuucguggugaccaccgacaucuccgagaugggcgcgaacuucaaggccgaccgcgucaucgacccccggcgcugccugaagcccgugauccugaccgacggccccgagcgggugauccucgccgggccgaugcccgucacggccgccagcgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagagccgcaagaccuucgucgagcucaugcggcgcggggaccugcccguguggcuggcccacaagguggccuccgagggcaucaaguacacggaccggaaguggugcuucgacggggagcgcaacaaccagauccucgaggagaacauggacgucgagaucuggaccaaggagggcgagcggaagaagcugcgcccgcgcuggcuggacgcgcggaccuacagcgacccccucgcccugaaggaguucaaggacuucgccgccggccgcaaguccaucgcccuggaccucgugaccgagaucgggcgggugcccagccaccuggcgcaccgcacgcggaacgcccuggacaaccucgucaugcugcacaccagcgagcacggcgggcgcgccuaccggcacgccguggaggagcugccggagaccauggagacccuccugcugcucggccugaugauccugcucaccgggggcgccaugcuguuccugaucuccggcaaggggaucggcaagaccagcaucgggcucaucugcgugaucgucuccagcggcaugcuguggauggcggacgugccccugcaguggaucgccuccgccaucgugcucgaguucuucaugaugguccugcugauccccgagcccgagaagcagcgcaccccgcaggacaaccagcucgccuacguggugaucgggauccugacccuggccgcgaucgucgccgccaacgagaugggccuccuggagacgaccaagcgggaccugggcaugagcaaggagcccgggguggugucccccaccagcuaccucgacgucgaccugcaccccgccuccgccuggacccuguacgcgguggccacgaccgugaucaccccgaugcuccgccacaccaucgagaacagcacggccaacgucucccuggccgcgaucgccaaccaggccguggugcugaugggccucgacaagggguggcccaucagcaagauggaccugggcgucccccugcucgcccuggggugcuacucccaggugaacccccugacccucaccgccgcggugcugcugcucgucacccacuacgccaucaucggcccgggccugcaggccaaggccacgcgggaggcccagaagcgcaccgcggccgggaucaugaagaaccccaccguggacggcaucaugaccaucgaccuggaccccgugaucuacgacagcaaguucgagaagcagcucgggcaggucaugcugcuggugcucugcgccgugcagcugcugcucaugcggacguccugggcccugugcgaggcccugacccucgcgaccggccccaucaccacgcugugggagggcagcccggggaaguucuggaacaccaccaucgccgucuccauggccaacaucuuccgcggcagcuaccuggccggggcgggccucgccuucuccaucaugaaguccguggggaccggccggcgcggcacggggagccagggcgagacccugggggagaaguggaagaagaagcugaaccagcucucccggaaggaguucgaccuguacaagaaguccggcaucaccgagguggaccgcaccgaggccaaggaggggcugaagcggggcgagaccacgcaccacgccgucucccgcggcagcgccaagcuccagugguucguggagcggaacauggugauccccgaggggcgcgucaucgaccugggcugcgggcgcggcgggugguccuacuacugcgcgggccugaagaaggugaccgaggugcggggcuacaccaagggcggccccgggcacgaggagcccgucccgaugagcaccuacggcuggaacaucgugaagcucauguccgggaaggacguguucuaccugccgcccgagaagugcgacacgcugcugugcgacaucggcgagagcucccccagcccgaccgucgaggagucccgcaccauccgggugcucaagaugguggagcccuggcugcgcaacaaccaguucugcaucaagguccugaaccccuacaugcccaccgugaucgagcaccucgagcggcugcagcgcaaguacggcgggaugcuggugcggaacccgcucagccgcaacuccacgcacgagauguacuggaucagcaacggcaccgggaacaucgucuccagcgugaacauggucucccggcugcugcucaaccgcuucaccaugacccaccggcgccccacgaucgagaaggacguggaccugggcgccggcacccggcacgugaacgccgagcccgagaccccgaacauggacgucaucggggagcgcaucaagcggaucaaggaggagcacagcuccaccuggcacuacgacgacgagaaccccuacaagacgugggccuaccacggcagcuacgaggugaaggccaccgggagcgcguccagcaugaucaacggcguggucaagcugcucaccaagcccugggacguggugcccauggucacccagauggccaugacggacaccaccccguucgggcagcagcgcguguucaaggagaagguggacacccggacgccccgccccaugcccggcacccggaaggucauggagaucaccgccgaguggcuguggcgcacccugggccgcaacaagaagccgcggcucugcacgcgcgaggaguucaccaagaaggugcggaccaacgccgccaugggggcgguguucaccgaggagaaccagugggacuccgcccgcgccgccgucgaggacgaggaguucuggaagcugguggaccgggagcgcgagcugcacaagcucggcaagugcgggagcugcguguacaacaugaugggcaagcgggagaagaagcugggggaguucggcaaggcgaagggcucccgcgccaucugguacauguggcugggggcccgguaccucgaguucgaggcccugggcuuccugaacgaggaccacugguucagccgcgagaacuccuacagcggggucgagggcgaggggcuccacaagcugggcuacauccugcgggacaucuccaagauccccggcggggccauguacgcggacgacacggccggcugggacacccgcaucaccgaggacgaccuccacaacgaggagaagaucacccagcagauggaccccgagcaccggcagcuggccaacgccaucuucaagcugacguaccagaacaagguggugaagguccagcgccccaccccgaaggggaccgugauggacaucaucagccggaaggaccagcgcggcuccggccagguggggaccuacggccucaacaccuucacgaacauggaggcccagcugguccggcagauggagggggagggcgugcugagcaaggcggaccucgagaacccccaccuccuggagaagaagaucacccaguggcucgagaccaaggggguggagcgccugaagcggauggccaucuccggcgacgacugcgucgugaagcccaucgacgaccgcuucgccaacgcccugcucgcccugaacgacaugggcaaggugcggaaggacaucccccaguggcagccgagcaagggguggcacgacuggcagcagguccccuucugcucccaccacuuccacgagcugaucaugaaggacggccgcaagcucguggugcccugccgcccccaggacgagcugaucgggcgggcgcgcaucagccagggcgccggguggucccugaaggagaccgccugccucggcaaggccuacgcccagauguggagccugauguacuuccaccggcgcgaccugcggcucgcguccaacgccaucugcagcgccgucccggugcacuggauccccacgagccgcaccaccugguccauccacgcccaccaccaguggaugaccacggaggacaugcugaccguguggaaccgggucuggaucgaggacaaccccuggauggaggacaagacccccgugaccacgugggaggacgugccguaccugggcaagcgcgaggaccaguggugcgggagccucaucggccugaccucccgggcgaccugggcccagaacauccugaccgccauccagcagguccgcagccucaucggggacgaggaguuccuggacuacaugcccuccaugaagcgguuccgcaaggaggaggagagcgagggcgccaucugguga

SEQ ID NO: 9971 - RNA, 9873 nt, Artificial Sequence
  derived and/or modified CDS sequence (opt1) from DENV-3__FJ639727__SS-prME
accagccugugccucaugaugaugcugcccgccacccuggccuuccaccucaccagccgggacggcgagccgcggaugaucguggggaagaacgagcggggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgggacaagcgguccgucgcccuggcgccccacgugggcauggggcuggacacccgcacccagaccuggaugagcgccgagggcgccuggcgccagguggagaaggucgagaccugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaagucccacaacggccgccugaucaccgcgaaccccguggucacgaagaaggaggagcccgugaacaucgaggccgagccgcccuucggggagagcaacaucgugaucggcaucggggacaaggcccucaagaucaacugguacaagaagggcuccagcaucgggaagauguucgaggccaccgcgcggggcgcccgccggauggccauccugggcgacaccgccugggacuucggguccgucggcggggugcugaacagccucggcaagauggugcaccagaucuucggguccgccuacaccgcgcuguucagcggcgucuccuggaucaugaagaucggcaucggggugcugcucacguggaucggccugaacagcaagaacaccuccaugagcuucuccugcaucgugaucgggaucaucacccuguaccucggcgccgucgugcaggccgacauggggugcgugaucaacuggaagggcaaggagcugaagugcggcagcgggaucuucgucaccaacgaggugcacacguggaccgagcaguacaaguuccaggccgacucccccaagcgccuggccaccgcgaucgccggcgccugggagaacggggugugcggcauccgcagcaccacgcggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacuccuggaagacgugggggaaggccaagaucgugaccgcggagacccagaacagcuccuucaucaucgacggccccaacacccccgagugccccagcgccagccgggccuggaacgugugggaggucgaggacuacggguucggcguguucacgaccaacaucuggcugaagcuccgcgagguguacacccaguccugcgaccaccggcugaugagcgccgcgaucaaggacgagcgcgccguccacgccgacaugggcuacuggaucgagucccagaagaacgggagcuggaagcuggagaaggccuccuucaucgaggugaagaccugcaccuggcccaagagccacacgcucugguccaacggcgugcuggagagcgacaugaucauccccaagucccuggccgggcccaucagccagcacaaccaccggccgggcuacuacacccagaccgcggggcccuggcaccucggcaagcuggagcuggacuucaacuacugcgagggcaccacggucgugaucaccgagaacugcgggacccgcggccccucccuccggaccacgaccgugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgccggggcccuguucacguucgugcuccugcuguccggccagaucaccuggcgcgacauggcgcacacccucaucaugaucggcagcaacgccagcgaccggauggggaugggcgucaccuaccuggcccugaucgccacguucaagauccagcccuuccucgcccugggguucuuccugcgcaagcucaccucccgggagaaccugcugcucggcgugggccuggcgauggccaccacccugcagcuccccgaggacaucgagcagauggccaacgggaucgcccugggccugaugacgcucaagcugaucacccaguucgagaccuaccagcuguggaccgcgcucgugagccugacgugcuccaacaccaucuucacccugaccgucgccuggcgcacggccacccucauccuggccggggugagccugcucccgcugugccaguccagcuccaugcggaagaccgacuggcugcccaugaccgucgccgcgaugggcgugccgccccugccgcuguucaucuucagccugaaggacacgcccaagcgccgcuccuggccccucaacgagggggugauggccgucggccuggugagcauccuggccuccagccuccugcggaacgacgugcccauggccggcccgcuggucgccgggggccuccugaucgcgugcuacgugaucaccgggaccuccgccgaccugaccguggagaaggccgccgacgucacgugggaggaggaggccgagcagaccggcgugagccacaaccucaugaucaccguggacgacgacgggaccaugcgcaucaaggacgacgagaccgagaacauccugacgguccugcucaagaccgcgcugcugaucguguccggcaucuuccccuacagcauccccgccacccuccugguguggcacaccuggcagaagcagacgcagcgguccggcguccugugggacgugcccagcccgcccgagacccagaaggccgagcucgaggaggggguguaccgcaucaagcagcagggcaucuucgggaagacccaggucggcgugggggugcagaaggagggcgucuuccacaccauguggcacgugacgcggggcgccgugcugacccacaacgggaagcgccuggagcccaacugggccuccgucaagaaggaccucaucagcuacggcgggggcuggcggcugagcgcgcaguggcagaagggggaggagguccaggugaucgccgucgagcccggcaagaacccgaagaacuuccagaccaugcccggcaucuuccagaccacgaccggggagaucggcgccaucgcccuggacuucaagcccgggaccuccggcagcccgaucaucaaccgcgagggcaaggugguggggcuguacggcaacggggucgugaccaagaacggcggguacguguccggcaucgcgcagacgaacgccgagcccgacggccccacccccgagcucgaggaggagauguucaagaagcggaaccugaccaucauggaccugcacccggggagcggcaagacccgcaaguaccuccccgccaucguccgggaggccaucaagcgccggcugcgcacgcugauccucgcccccacccgggugguggcggccgagauggaggaggcccugaaggggcugcccauccgcuaccagaccaccgccacgaaguccgagcacaccggccgggagaucgucgaccucaugugccacgccaccuucaccaugcgccugcugagcccggugcgggugcccaacuacaaccucgucgugauggacgaggcgcacuucacggaccccgccuccaucgccgcccgcggguacaucagcacccgggugggcaugggcgaggccgcggccaucuucaugaccgccacgccgcccgggacggccgaggcguucccccaguccaacgcccccauccaggacgaggagcgcgacauccccgagcgcagcuggaacuccggcaacgaguggaucaccgacuucgucgggaagaccgugugguucgugcccagcaucaaggccggcaacgacaucgccaacugccugcggaagaacgggaagaaggucauccagcugucccgcaagaccuucgacacggaguaccagaagacccggcucaacgacugggacuucguggugaccaccgacaucagcgagaugggcgccaacuuccgcgcggaccgggucaucgacccccgccggugccugaagcccgugauccugacggacggccccgagcgcgugauccucgccgggccgaugcccgucaccgccgccuccgccgcgcagcggcgcggccggguggggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgccgcgaucgacggcgaguaccgccugaagggcgagucccggaagacguucgucgagcucaugcgccgcggggaccugcccguguggcuggcccacaagguggccagcgagggcaucaaguacaccgaccgcaaguggugcuucgacggggagcggaacaaccagauccucgaggagaacauggacgucgagaucuggaccaaggagggcgagcgcaagaagcugcgcccgcgguggcuggacgcccgcaccuacuccgacccccucgcgcugaaggaguucaaggacuucgccgccggccgcaagagcaucgcccuggaccucgugacggagaucgggcgcgugcccagccaccuggcccaccggacccgcaacgcgcuggacaaccucgucaugcugcacaccuccgagcacggcgggcgggccuaccgccacgccguggaggagcugccggagaccauggagacgcuccugcugcucggccugaugauccugcucaccgggggcgccaugcuguuccugaucagcggcaaggggaucggcaagaccuccaucgggcucaucugcgugaucgucagcuccggcaugcuguggauggccgacgugccccugcaguggaucgcgagcgccaucgugcucgaguucuucaugaugguccugcugauccccgagcccgagaagcagcggaccccgcaggacaaccagcucgccuacguggugaucgggauccugacgcuggccgccaucgucgcggccaacgagaugggccuccuggagaccaccaagcgcgaccugggcauguccaaggagcccgggguggugagccccaccuccuaccucgacgucgaccugcaccccgccagcgccuggacgcuguacgccguggcgaccaccgugaucaccccgaugcuccggcacacgaucgagaacuccaccgccaacgucagccuggccgccaucgcgaaccaggccguggugcugaugggccucgacaagggguggcccaucuccaagauggaccugggcgucccccugcucgcccuggggugcuacagccaggugaacccccugacccucaccgccgccgugcugcugcucgucacgcacuacgcgaucaucggcccgggccugcaggccaaggccacccgcgaggcccagaagcggaccgccgcggggaucaugaagaaccccaccguggacggcaucaugacgaucgaccuggaccccgugaucuacgacuccaaguucgagaagcagcucgggcaggucaugcugcuggugcucugcgccgugcagcugcugcucaugcgcaccagcugggcccugugcgaggcccugacccucgccaccggccccaucacgacccugugggagggcuccccggggaaguucuggaacaccaccaucgcggucagcauggccaacaucuuccggggcuccuaccuggccggggccggccucgcguucagcaucaugaaguccguggggacgggccgccggggcaccgggucccagggcgagacccugggggagaaguggaagaagaagcugaaccagcucagccgcaaggaguucgaccuguacaagaaguccggcaucaccgagguggaccggaccgaggccaaggaggggcugaagcgcggcgagacgacccaccacgccgucagccggggcuccgccaagcuccagugguucguggagcgcaacauggugauccccgaggggcgcgucaucgaccugggcugcgggcggggcggguggagcuacuacugcgccggccugaagaaggugaccgaggugcgcggcuacaccaagggcgggcccgggcacgaggagcccgucccgauguccacguacggcuggaacaucgugaagcucaugagcgggaaggacguguucuaccugccgcccgagaagugcgacacccugcugugcgacaucggcgaguccagccccuccccgaccgucgaggagagccggaccauccgcgugcucaagaugguggagcccuggcugcggaacaaccaguucugcaucaagguccugaaccccuacaugcccacggugaucgagcaccucgagcgccugcagcggaaguacggcgggaugcuggugcgcaacccgcucucccggaacagcacccacgagauguacuggaucuccaacggcaccgggaacaucgucagcuccgugaacauggucagccgccugcugcucaaccgguucaccaugacgcaccgccggcccaccaucgagaaggacguggaccugggcgcgggcacccgccacgugaacgccgagcccgagaccccgaacauggacgucaucggggagcggaucaagcgcaucaaggaggagcacuccagcacguggcacuacgacgacgagaaccccuacaagaccugggccuaccacggcagcuacgaggugaaggccaccggguccgccagcuccaugaucaacggcguggucaagcugcucaccaagcccugggacguggugcccauggucacgcagauggcgaugaccgacaccaccccguucgggcagcagcggguguucaaggagaagguggacacgcgcacgccccggcccaugcccggcacccgcaaggucauggagaucaccgccgaguggcuguggcgcacgcugggccggaacaagaagccgcgccucugcacccgggaggaguucaccaagaaggugcgcaccaacgccgccaugggggccguguucacggaggagaaccagugggacagcgcgcgggccgccgucgaggacgaggaguucuggaagcugguggaccgcgagcgggagcugcacaagcucggcaagugcggguccugcguguacaacaugaugggcaagcgcgagaagaagcugggggaguucggcaaggccaagggcagccgggcgaucugguacauguggcugggggcccgcuaccucgaguucgaggcccugggcuuccugaacgaggaccacugguucucccgggagaacagcuacuccggggucgagggcgaggggcuccacaagcugggcuacauccugcgcgacaucagcaagauccccggcggggccauguacgccgacgacaccgcgggcugggacacccggaucaccgaggacgaccuccacaacgaggagaagaucacgcagcagauggaccccgagcaccgccagcuggccaacgccaucuucaagcugaccuaccagaacaagguggugaagguccagcggcccaccccgaaggggaccgugauggacaucaucucccgcaaggaccagcggggcagcggccagguggggaccuacggccucaacacguucaccaacauggaggcccagcugguccgccagauggagggggagggcgugcuguccaaggccgaccucgagaacccccaccuccuggagaagaagaucacccaguggcucgagaccaaggggguggagcggcugaagcgcauggcgaucagcggcgacgacugcgucgugaagcccaucgacgaccgguucgccaacgcccugcucgcccugaacgacaugggcaaggugcgcaaggacaucccccaguggcagccguccaagggguggcacgacuggcagcagguccccuucugcagccaccacuuccacgagcugaucaugaaggacggccgcaagcucguggugcccugccggccccaggacgagcugaucgggcgcgcccggaucucccagggcgcgggguggagccugaaggagacggccugccucggcaaggccuacgcccagauguggucccugauguacuuccaccgccgggaccugcgccucgccagcaacgcgaucugcagcgccgucccggugcacuggauccccaccucccggaccaccuggagcauccacgcccaccaccaguggaugacgaccgaggacaugcugaccguguggaaccgcgucuggaucgaggacaaccccuggauggaggacaagacccccgugacgaccugggaggacgugccguaccugggcaagcgggaggaccaguggugcgggucccucaucggccugaccagccgcgccaccugggcgcagaacauccugacggccauccagcagguccggucccucaucggggacgaggaguuccuggacuacaugcccagcaugaagcgcuuccggaaggaggaggaguccgagggcgccaucugguga

SEQ ID NO: 9972 - RNA, 9873 nt, Artificial Sequence
  derived and/or modified CDS sequence (opt1) from DENV-3__GQ868629__SS-prME
accagccugugccucaugaugaugcugcccgccacccuggccuuccaccucaccagccgggacggcgagccccggaugaucguggggaagaacgagcgcggcaagagccugcuguucaagaccgcgagcgggaucaacaugugcacccucaucgccauggaccugggcgagaugugcgacgacaccgucaccuacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaucaccgagacccccacguggaaccgcaaggagcugcuggugaccuucaagaacgcccacgccaagaagcaggagguggucgugcucgggagccaggagggcgccaugcacaccgcgcugaccggggccacggagauccagaacuccggcgggaccagcaucuucgccggccaccugaagugccggcucaagauggacaagcuggagcugaagggcauguccuacgccaugugccucaacaccuucgugcugaagaaggaggucagcgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggaguccaacaucgugaucggcaucggggacaaggcccucaagaucaacugguacaagaagggcagcuccaucgggaagauguucgaggcgacggcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucaccuggaucggccugaacuccaagaacacgagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacaccuggacggagcaguacaaguuccaggccgacagccccaagcgccuggcgaccgccaucgccggcgccugggagaacggggugugcggcauccgcuccaccacccggauggagaaccuccuguggaagcagaucgccaacgagcugaacuacauccucugggagaacaacaucaagcugacggucguggugggggacaucaucggcguccuggagcagggcaagcgcacccucacgccccagccgauggagcugaaguacagcuggaagaccugggggaaggcgaagaucgugacggccgagacccagaacuccagcuucaucaucgacggccccaacacccccgagugccccuccgccagccgggccuggaacgugugggaggucgaggacuacggguucggcguguucaccacgaacaucuggcugaagcuccgcgagguguacacccagagcugcgaccaccggcugauguccgcggccaucaaggacgagcgcgccguccacgccgacaugggcuacuggaucgagagccagaagaacggguccuggaagcuggagaaggccagcuucaucgaggugaagaccugcaccuggccgaagucccacacccucuggagcaacggcgugcuggaguccgacaugaucauccccaagagccuggcggggcccaucucccagcacaaccaccggccgggcuaccacacgcagaccgccgggcccuggcaccucggcaagcuggagcuggacuucaacuacugcgagggcaccaccgucgugaucacggagaacugcgggacccgcggccccagccuccggaccaccacgguguccgggaagcugauccacgaguggugcugccgcagcugcacccugcccccgcuccgguacaugggcgaggacgggugcugguacggcauggagauccgccccaucaacgagaaggaggagaacauggucaagucccuggugagcgccggcuccgggaagguggacaacuucaccaugggcguccugugccucgccauccuguucgaggaggugaugcgggggaaguucggcaagaagcacaugaucgccggggugcuguucaccuucguccuccugcugagcggccagaucacguggcgcgacauggcgcacacccucaucaugaucggcuccaacgccagcgaccggauggggaugggcgugaccuaccuggcccugaucgccaccuucaagauccagcccuuccucgcccugggguucuuccugcgcaagcucacgagccgggagaaccugcugcucggcgugggccuggcgauggccaccacccugcagcuccccgaggacaucgagcagauggccaacgggaucgcccugggccugaugacccucaagcugaucacgcaguucgagaccuaccagcuguggaccgcgcucgucucccugaccugcagcaacacgaucuucacccugaccguggccuggcgcaccgccacgcucauccuggccggggucucccugcucccgcugugccagagcuccagcaugcggaagaccgacuggcugcccaugaccguggccgcgaugggcgugccgccccugccgcuguucaucuucucccugaaggacacccccaagcgccgcagcuggccccucaacgagggggucauggccgugggccugguguccauccuggccagcucccuccugcggaacgacguccccauggccggcccgcugguggccgggggccuccugaucgcgugcuacgugaucacggggaccagcgccgaccugaccgucgagaaggccgccgacgugaccugggaggaggaggccgagcagacgggcgugucccacaaccucaugaucaccgucgacgacgacgggaccaugcgcaucaaggacgacgagaccgagaacauccugaccgugcugcucaagacggcgcugcugaucgugagcggcaucuuccccuacuccauccccgccacccuccuggucuggcacaccuggcagaagcagacccagcggagcggcgugcugugggacgugcccuccccgcccgagacgcagaaggccgagcucgaggagggggucuaccgcaucaagcagcagggcaucuucgggaagacccaggugggcguggggguccagaaggagggcguguuccacaccauguggcacgugacccggggcgccguccugacgcacaacgggaagcgccuggagcccaacugggccagcgugaagaaggaccucaucuccuacggcgggggcuggcggcugagcgcgcaguggcagaagggggaggaggugcaggucaucgccguggagcccggcaagaacccgaagaacuuccagaccaugcccggcaucuuccagaccaccacgggggagaucggcgccaucgcccuggacuucaagcccgggaccagcggcuccccgaucaucaaccgcgagggcaagguggucgggcuguacggcaacgggguggugaccaagaacggcggguacgucagcggcaucgcgcagaccaacgccgagcccgacggccccacgcccgagcucgaggaggagauguucaagaagcggaaccugaccaucauggaccugcacccgggguccggcaagacccgcaaguaccuccccgccaucgugcgggaggccaucaagcgccggcugcgcacccugauccucgcccccacgcggguggucgcggccgagauggaggaggcccugaaggggcugcccauccgcuaccagaccaccgccaccaagagcgagcacacgggccgggagaucguggaccucaugugccacgccaccuucaccaugcgccugcuguccccggugcggguccccaacuacaaccucgugaucauggacgaggcgcacuucaccgaccccgccagcaucgccgcccgcggguacaucuccacgcgggugggcaugggcgaggccgcggccaucuucaugaccgccacgccgcccgggaccgccgaggcguucccccagagcaacgcccccauccaggacgaggagcgcgacauccccgagcgcuccuggaacagcggcaacgaguggaucacggacuucgucgggaagaccgugugguucgugcccuccaucaaggccggcaacgacaucgccaacugccugcggaagaacgggaagaaggucauccagcugagccgcaagaccuucgacaccgaguaccagaagacgcggcucaacgacugggacuucguggugaccaccgacaucuccgagaugggcgccaacuucaaggcggaccgcgucaucgacccccggcgcugccugaagcccgugauccugaccgacggccccgagcgggugauccucgccgggccgaugcccgucacggccgccagcgccgcgcagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgccgcgaucgacggcgaguaccggcugaagggcgagagccgcaagaccuucgucgagcucaugcggcgcggggaccugcccguguggcuggcccacaagguggccuccgagggcaucaaguacacggaccggaaguggugcuucgacggggagcgcaacaaccagauccucgaggagaacauggacgucgagaucuggaccaaggagggcgagcggaagaagcugcgcccgcgcuggcuggacgcccggaccuacagcgacccccucgcgcugaaggaguucaaggacuucgccgccggccgcaaguccaucgcccuggaccucgugaccgagaucgggcgggugcccagccaccuggcccaccgcacgcggaacgcgcuggacaaccucgucaugcugcacaccagcgagcacggcgggcgcgccuaccggcacgccguggaggagcugccggagaccauggagacccuccugcugcucggccugaugauccugcucaccggcggggccaugcuguuccugaucuccgggaaggggaucggcaagaccagcaucgggcucaucugcgugaucgucuccagcggcaugcuguggauggccgacgugccccugcaguggaucgcguccgccaucgugcucgaguucuucaugaugguccugcugauccccgagcccgagaagcagcgcaccccgcaggacaaccagcucgccuacguggugaucgggauccugacccuggccgccaucgucgcggccaacgagaugggccuccuggagacgaccaagcgggaccugggcaugagcaaggagcccgggguggugucccccaccagcuaccucgacgucgaccugcaccccgccuccgccuggacccuguacgccguggcgacgaccgugaucaccccgaugcuccgccacaccaucgagaacagcacggccaacgucucccuggccgccaucgcgaaccaggccguggugcugaugggccucgacaagggguggcccaucagcaagauggaccugggcgucccccugcucgcccuggggugcuacucccaggugaacccccugacccucaccgccgccgugcugcugcucgucacccacuacgcgaucaucggcccgggccugcaggccaaggccacgcgggaggcccagaagcgcaccgccgcggggaucaugaagaaccccaccguggacggcaucaugaccaucgaccuggaccccgugaucuacgacagcaaguucgagaagcagcucgggcaggucaugcugcuggugcucugcgccgugcagcugcugcucaugcggacguccugggcccugugcgaggcccugacccucgccaccggccccaucaccacgcugugggagggcagcccggggaaguucuggaacaccaccaucgcggucuccauggccaacaucuuccgcggcagcuaccuggccggggccggccucgcguucuccaucaugaaguccguggggaccggccggcgcggcacggggagccagggcgagacccugggggagaaguggaagaagaagcugaaccagcucucccggaaggaguucgaccuguacaagaaguccggcaucaccgagguggaccgcaccgaggccaaggaggggcugaagcggggcgagaccacgcaccacgccgucucccgcggcagcgccaagcuccagugguucguggagcggaacauggugauccccgaggggcgcgucaucgaccugggcugcgggcgcggcgggugguccuacuacugcgccggccugaagaaggugaccgaggugcggggcuacaccaagggcggccccgggcacgaggagcccgucccgaugagcaccuacggcuggaacaucgugaagcucauguccgggaaggacguguucuaccugccgcccgagaagugcgacacgcugcugugcgacaucggcgagagcucccccagcccgaccgucgaggagucccgcaccauccgggugcucaagaugguggagcccuggcugcgcaacaaccaguucugcaucaagguccugaaccccuacaugcccaccgugaucgagcaccucgagcggcugcagcgcaaguacggcgggaugcuggugcggaacccgcucagccgcaacuccacgcacgagauguacuggaucagcaacggcaccgggaacaucgucuccagcgugaacauggucucccggcugcugcucaaccgcuucaccaugacccaccggcgccccacgaucgagaaggacguggaccugggcgcgggcacccggcacgugaacgccgagcccgagaccccgaacauggacgucaucggggagcgcaucaagcggaucaaggaggagcacagcuccaccuggcacuacgacgacgagaaccccuacaagacgugggccuaccacggcagcuacgaggugaaggccaccgggagcgccuccagcaugaucaacggcguggucaagcugcucaccaagcccugggacguggugcccauggucacccagauggcgaugacggacaccaccccguucgggcagcagcgcguguucaaggagaagguggacacccggacgccccgccccaugcccggcacccggaaggucauggagaucaccgccgaguggcuguggcgcacccugggccgcaacaagaagccgcggcucugcacgcgcgaggaguucaccaagaaggugcggaccaacgccgccaugggggccguguucaccgaggagaaccagugggacuccgcgcgcgccgccgucgaggacgaggaguucuggaagcugguggaccgggagcgcgagcugcacaagcucggcaagugcgggagcugcguguacaacaugaugggcaagcgggagaagaagcugggggaguucggcaaggccaagggcucccgcgcgaucugguacauguggcugggggcccgguaccucgaguucgaggcccugggcuuccugaacgaggaccacugguucagccgcgagaacuccuacagcggggucgagggcgaggggcuccacaagcugggcuacauccugcgggacaucuccaagauccccggcggggccauguacgccgacgacacggcgggcugggacacccgcaucaccgaggacgaccuccacaacgaggagaagaucacccagcagauggaccccgagcaccggcagcuggccaacgccaucuucaagcugacguaccagaacaagguggugaagguccagcgccccaccccgaaggggaccgugauggacaucaucagccggaaggaccagcgcggcuccggccagguggggaccuacggccucaacaccuucacgaacauggaggcccagcugguccggcagauggagggggagggcgugcugagcaaggccgaccucgagaacccccaccuccuggagaagaagaucacccaguggcucgagaccaaggggguggagcgccugaagcggauggcgaucuccggcgacgacugcgucgugaagcccaucgacgaccgcuucgccaacgcccugcucgcccugaacgacaugggcaaggugcggaaggacaucccccaguggcagccgagcaagggguggcacgacuggcagcagguccccuucugcucccaccacuuccacgagcugaucaugaaggacggccgcaagcucguggugcccugccgcccccaggacgagcugaucgggcgggcccgcaucagccagggcgcgggguggucccugaaggagaccgccugccucggcaaggccuacgcccagauguggagccugauguacuuccaccggcgcgaccugcggcucgccuccaacgcgaucugcagcgccgucccggugcacuggauccccacgagccgcaccaccugguccauccacgcccaccaccaguggaugaccacggaggacaugcugaccguguggaaccgggucuggaucgaggacaaccccuggauggaggacaagacccccgugaccacgugggaggacgugccguaccugggcaagcgcgaggaccaguggugcgggagccucaucggccugaccucccgggccaccugggcgcagaacauccugaccgccauccagcagguccgcagccucaucggggacgaggaguuccuggacuacaugcccuccaugaagcgguuccgcaaggaggaggagagcgagggcgccaucugguga

SEQ ID NO: 9973 - RNA, 9873 nt, Artificial Sequence
  derived and/or modified CDS sequence (opt1) from DENV-3__FJ639728__SS-prME
accagccugugccucaugaugaugcugcccgccacccuggccuuccaccucaccagccgcgacggcgagccgcggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccgucgcccuggcgccccacgugggcauggggcuggacacccgcacccagaccuggaugagcgccgagggcgccuggcgccagguggagaaggucgagaccugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacacguggaccgagcaguacaaguuccaggccgacagccccaagcgccuggcgaccgccaucgccggcgccugggagaacggggugugcggcauccgcuccaccacgcggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacagcuggaagacgugggggaaggcgaagaucgugaccgccgagacccagaacuccagcuucaucaucgacggccccaacacccccgagugccccuccgcccugcgggccuggaacgugugggaggucgaggacuacggguucggcguguucacgaccaacaucuggcucaagcugcgcgagguguacacccagagcugcgaccaccggcugaugagcgcggccaucaaggacgagcgcgccguccacgccgacaugggcuacuggaucgagucccagaagaacgggagcuggaagcucgagaaggccuccuucaucgaggugaagaccugcaccuggcccaagagccacacgcugugguccaacggcgugcuggagagcgacaugaucauccccaagucccucgcggggcccaucagccagcacaaccaccggccgggcuaccacacccagaccgccgggcccuggcaccugggcaagcuggagcucgacuucaacuacugcgagggcaccacggucgugaucaccgagaacugcgggacccgcggccccucccugcggaccacgaccgugagcgggaagcugauccacgaguggugcugccgcuccugcacccugccgccccugcgguacaugggcgaggacgggugcugguacggcauggagauccgccccaucaacgagaaggaggagaacauggucaagagccugguguccgccggcagcgggaagguggacaacuucaccaugggcguccucugccuggccauccuguucgaggaggugaugcgggggaaguucggcaagaagcacaugaucgccgggguccuguucacguucguccugcugcucuccggccagaucaccuggcgcgacauggcgcacacccugaucaugaucggcagcaacgccuccgaccggauggggaugggcgugaccuaccuggcccucaucgccacguucaagauccagcccuuccuggcccugggguucuuccuccgcaagcugaccagccgggagaaccugcuccugggcgugggccuggcgauggccaccacccuccagcugcccgaggacaucgagcagauggccaacgggaucgcccugggccucaugacgcugaagcugaucacccaguucgagaccuaccagcucuggaccgcgcuggucagccugacgugcuccaacaccaucuucacccucaccguggccuggcgcacggccacccugauccuggccggggucagccuccugccccugugccaguccagcuccaugcggaagaccgacuggcuccccaugaccguggccgcgaugggcgugccgccccucccgcuguucaucuucagccucaaggacacgcccaagcgccgcuccuggccccugaacgagggggucauggccgugggccuggugagcauccucgccuccagccugcugcggaacgacguccccauggccggcccgcucguggccgggggccugcugaucgcgugcuacgugaucaccgggaccuccgccgaccucaccgucgagaaggccgccgacgugacgugggaggaggaggccgagcagaccggcgugagccacaaccugaugaucaccgucgacgacgacgggaccaugcgcaucaaggacgacgagaccgagaacauccugacggugcuccugaagaccgcgcugcucaucguguccggcaucuuccccuacagcauccccgccacccugcuggucuggcacaccuggcagaagcagacgcagcgguccggcgugcucugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgccguccugacccacaacgggaagcgccucgagcccaacugggccuccgugaagaaggaccugaucagcuacggcgggggcuggcggcuguccgcgcaguggcagaagggggaggaggugcaggucaucgccguggagcccggcaagaacccgaagaacuuccagaccaugcccggcaucuuccagaccacgaccggggagaucggcgccaucgcccuggacuucaagcccgggaccagcggcagcccgaucaucaaccgcgagggcaagguggucgggcucuacggcaacgggguggugaccaagaacggcggguacgucuccggcaucgcgcagacgaacgccgagcccgacggccccacccccgagcuggaggaggagauguucaagaagcggaaccugaccaucauggaccuccacccggggagcggcaagacccgcaaguaccugcccgccaucgugcgggaggccaucaagcgccggcugcgcacgcucauccuggcccccacccggguggucgcggccgagauggaggaggcccugaaggggcuccccauccgcuaccagaccaccgccacgaaguccgagcacaccggccgggagaucguggaccugaugugccacgccaccuucaccaugcgccugcucagcccggugcggguccccaacuacaaccuggugaucauggacgaggcgcacuucacggaccccgccuccaucgccgcccgcggguacaucagcacccgggugggcaugggcgaggccgcggccaucuucaugaccgccacgcccccggggacggccgaggcguucccccaguccaacgcccccauccaggacgaggagcgcgacauccccgagcgcagcuggaacuccggcaacgaguggaucaccgacuucgucgggaagaccgugugguucgugccgagcaucaaggccggcaacgacaucgccaacugccugcggaagaacgggaagaaggucauccagcucucccgcaagaccuucgacacggaguaccagaagacccggcugaacgacugggacuucguggugaccaccgacaucagcgagaugggcgccaacuucaaggcggaccgcgucaucgacccccggcgcugccugaagcccgugauccucacggacggccccgagcgggugauccuggccgggccgaugcccgucaccgccgccuccgccgcgcagcgccggggccgcguggggcggaacccccagaaggagaacgaccaguacaucuucaccggccagccccugaacaacgacgaggaccacgcccacuggaccgaggccaagaugcuccuggacaacaucaacaccccggaggggaucauccccgcccuguucgagcccgagcgcgagaaguccgccgcgaucgacggcgaguaccggcucaagggcgagucccgcaagacguucgucgagcugaugcggcgcggggaccugcccguguggcucgcccacaagguggccagcgagggcaucaaguacaccgaccggaaguggugcuucgacggggagcgcaacaaccagauccuggaggagaacauggacgucgagaucuggaccaaggagggcgagcggaagaagcugcgcccgcgcuggcucgacgcccggaccuacuccgacccccuggcgcugaaggaguucaaggacuucgccgccggccgcaagagcaucgcccucgaccuggugacggagaucgggcgggugcccucccaccuggcccaccgcacccggaacgcgcucgacaaccuggucaugcugcacaccagcgagcacggcgggcgcgccuaccggcacgccguggaggagcucccggagaccauggagacgcugcugcuccugggccugaugauccuccugaccgggggcgccaugcuguuccucaucagcggcaaggggaucggcaagaccuccaucgggcugaucugcgugaucgucagcuccggcaugcuguggauggccgacgugccccuccaguggaucgcgagcgccaucgugcuggaguucuucaugaugguccugcucauccccgagcccgagaagcagcgcaccccgcaggacaaccagcuggccuacguggugaucgggauccugacgcucgccgccaucgucgcggccaacgagaugggccugcuggagaccaccaagcgggaccucggcauguccaaggagcccgggguggugagccccaccuccuaccuggacgucgaccugcaccccgccagcgccuggacgcucuacgccguggcgaccaccgugaucaccccgaugcugcgccacacgaucgagaacuccaccgccaacgucagccuggccgccaucgcgaaccaggccguggugcucaugggccuggacaagggguggcccaucuccaagauggaccugggcgucccccuccuggcccuggggugcuacagccaggugaacccccucacccugaccgccgccgugcugcuccuggucacgcacuacgcgaucaucggcccgggccugcaggccaaggccacccgggaggcccagaagcgcaccgccgcggggaucaugaagaaccccaccguggacggcaucaugacgaucgaccucgaccccgugaucuacgacuccaaguucgagaagcagcuggggcaggucaugcugcucgugcugugcgccgugcagcugcuccugaugcggaccagcugggcccugugcgaggcccucacccuggccaccggccccaucacgacccugugggagggcuccccggggaaguucuggaacaccaccaucgcggucagcauggccaacaucuuccgcggcuccuaccucgccggggccggccuggcguucagcaucaugaaguccguggggacgggccggcgcggcaccgggagccagggcgagacccugggggagaaguggaagaagaagcucaaccagcugagccggaaggaguucgaccuguacaagaaguccggcaucaccgagguggaccgcaccgaggccaaggaggggcucaagcggggcgagacgacccaccacgccgucagccgcggcuccgccaagcugcagugguucguggagcggaacauggugauccccgaggggcgcgucaucgaccugggcugcgggcgcggcggguggagcuacuacugcgccggccucaagaaggugaccgaggugcggggcuacaccaagggcgggcccgggcacgaggagcccgucccgauguccacguacggcuggaacaucgugaagcugaugagcgggaaggacguguucuaccugccgcccgagaagugcgacacccugcucugcgacaucggcgaguccagccccuccccgaccgucgaggagagccgcaccauccgggugcugaagaugguggagcccuggcugcgcaacaaccaguucugcaucaagguccucaaccccuacaugcccacggugaucgagcaccuggagcggcugcagcgcaaguacggcgggaugcucgugcggaacccgcugucccgcaacagcacccacgagauguacuggaucuccaacggcaccgggaacaucgucagcuccgugaacauggucagccggcugcuccugaaccgcuucaccaugacgcaccggcgccccaccaucgagaaggacguggaccugggcgcgggcacccggcacgugaacgccgagcccgagaccccgaacauggacgucaucggggagcgcaucaagcggaucaaggaggagcacuccagcacguggcacuacgacgacgagaaccccuacaagaccugggccuaccacggcuccuacgaggugaaggccaccgggagcgccagcuccaugaucaacggcguggucaagcuccugaccaagcccugggacguggugcccauggucacgcagauggcgaugaccgacaccaccccguucgggcagcagcgcguguucaaggagaagguggacacgcggacgccccggcccaugcccggcacccggaaggucauggagaucaccgccgaguggcuguggcgcacgcucggccgcaacaagaagccgcggcugugcacccgcgaggaguucaccaagaaggugcggaccaacgccgccaugggggccguguucacggaggagaaccagugggacagcgcgcgcgccgccgucgaggacgaggaguucuggaagcugguggaccgggagcgcgagcuccacaagcugggcaagugcggguccugcguguacaacaugaugggcaagcgggagaagaagcugggggaguucggcaaggccaagggcagccgcgcgaucugguacauguggcucggggcccgguaccuggaguucgaggcccugggcuuccucaacgaggaccacugguucucccgcgagaacagcuacuccggggucgagggcgaggggcugcacaagcugggcuacauccuccgggacaucagcaagauccccggcggggccauguacgccgacgacaccgcgggcugggacacccgcaucaccgaggacgaccugcacaacgaggagaagaucacgcagcagauggaccccgagcaccggcagcuggccaacgccaucuucaagcucaccuaccagaacaagguggugaagguccagcgccccaccccgaaggggaccgugauggacaucaucucccggaaggaccagcgcggcagcggccagguggggaccuacggccugaacacguucaccaacauggaggcccagcugguccggcagauggagggggagggcgugcucuccaaggccgaccuggagaacccccaccuccucgagaagaagaucacccaguggcuggagaccaaggggguggagcgccugaagcggauggcgaucagcggcgacgacugcgucgugaagcccaucgacgaccgcuucgccaacgcccuccuggcccugaacgacaugggcaaggugcggaaggacaucccccaguggcagccguccaagggguggcacgacuggcagcagguccccuucugcagccaccacuuccacgagcucaucaugaaggacggccgcaagcugguggugcccugccgcccccaggacgagcugaucgggcgggcccgcaucucccagggcgcgggguggagccucaaggagacggccugccugggcaaggccuacgcccagauguggucccugauguacuuccaccggcgcgaccuccggcuggccagcaacgcgaucugcuccgccgucccggugcacuggauccccaccagccgcaccaccuggagcauccacgcccaccaccaguggaugacgaccgaggacaugcugaccguguggaaccgggucuggaucgaggacaaccccuggauggaggacaagacccccgugacgaccugggaggacgugccguaccucggcaagcgcgaggaccaguggugcgggucccugaucggccugaccagccgggccaccugggcgcagaacauccucacggccauccagcagguccgcucccugaucggggacgaggaguuccuggacuacaugcccagcaugaagcgguuccgcaaggaggaggaguccgagggcgccaucugguga

SEQ ID NO: 9974 - RNA, 9873 nt, Artificial Sequence
  derived and/or modified CDS sequence (opt1) from DENV-3__FJ639729__SS-prME
accagccugugccucaugaugaugcugcccgccacccuggccuuccaccucaccagccgggacggcgagccccggaugaucguggggaagaacgagcgcggcaagagccugcuguucaagaccgcgagcgggaucaacaugugcacccucaucgccauggaccugggcgagaugugcgacgacaccgucaccuacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaucaccgagacccccacguggaaccgcaaggagcugcuggugaccuucaagaacgcccacgccaagaagcaggagguggucgugcucgggagccaggagggcgccaugcacaccgcgcugaccggggccacggagauccagaacuccggcgggaccagcaucuucgccggccaccugaagugccggcucaagauggacaagcuggagcugaagggcauguccuacgccaugugccucaacaccuucgugcugaagaaggaggucagcgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggaguccaacaucgugaucggcaucggggacaaggcccucaagaucaacugguacaagaagggcagcuccaucgggaagauguucgaggcgacggcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucaccuggaucggccugaacuccaagaacacgagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacaccuggacggagcaguacaaguuccaggccgacagccccaagcgccuggcgaccgccaucgccggcgccugggagaacggggugugcggcauccgcuccaccacccggauggagaaccuccuguggaagcagaucgccaacgagcugaacuacauccucugggagaacaacaucaagcugacggucguggugggggacaucaucggcguccuggagcagggcaagcgcacccucacgccccagccgauggagcugaaguacagcuggaagaccugggggaaggcgaagaucgugacggccgagacccagaacuccagcuucaucaucgacggccccaacacccccgagugccccuccgccagccgggccuggaacgugugggaggucgaggacuacggguucggcguguucaccacgaacaucuggcugaagcuccgcgagguguacacccagagcugcgaccaccggcugauguccgcggccaucaaggacgagcgcgccguccacgccgacaugggcuacuggaucgagagccagaagaacggguccuggaagcuggagaaggccagcuucaucgaggugaagaccugcaccuggccgaagucccacacccucuggagcaacggcgugcuggaguccgacaugaucauccccaagagccuggcggggcccaucucccagcacaaccaccggccgggcuaccacacgcagaccgccgggcccuggcaccucggcaagcuggagcuggacuucaacuacugcgagggcaccaccgucgugaucacggagaacugcgggacccgcggccccagccuccggaccaccacgguguccgggaagcugauccacgaguggugcugccgcagcugcacccugcccccgcuccgguacaugggcgaggacgggugcugguacggcauggagauccgccccaucaacgagaaggaggagaacauggucaagucccuggugagcgccggcuccgggaagguggacaacuucaccaugggcguccugugccucgccauccuguucgaggaggugaugcgggggaaguucggcaagaagcacaugaucgccggggugcuguucaccuucguccuccugcugagcggccagaucacguggcgcgacauggcgcacacccucaucaugaucggcuccaacgccagcgaccggauggggaugggcgugaccuaccuggcccugaucgccaccuucaagauccagcccuuccucgcccugggguucuuccugcgcaagcucacgagccgggagaaccugcugcucggcgugggccuggcgauggccaccacccugcagcuccccgaggacaucgagcagauggccaacgggaucgcccugggccugaugacccucaagcugaucacgcaguucgagaccuaccagcuguggaccgcgcucgucucccugaccugcagcaacacgaucuucacccugaccguggccuggcgcaccgccacgcucauccuggccggggucucccugcucccgcugugccagagcuccagcaugcggaagaccgacuggcugcccaugaccguggccgcgaugggcgugccgccccugccgcuguucaucuucucccugaaggacacccccaagcgccgcagcuggccccucaacgagggggucauggccgugggccugguguccauccuggccagcucccuccugcggaacgacguccccauggccggcccgcugguggccgggggccuccugaucgcgugcuacgugaucacggggaccagcgccgaccugaccgucgagaaggccgccgacgugaccugggaggaggaggccgagcagacgggcgugucccacaaccucaugaucaccgucgacgacgacgggaccaugcgcaucaaggacgacgagaccgagaacauccugaccgugcugcucaagacggcgcugcugaucgugagcggcaucuuccccuacuccauccccgccacccuccuggucuggcacaccuggcagaagcagacccagcggagcggcgugcugugggacgugcccuccccgcccgagacgcagaaggccgagcucgaggagggggucuaccgcaucaagcagcagggcaucuucgggaagacccaggugggcguggggguccagaaggagggcguguuccacaccauguggcacgugacccggggcgccguccugacgcacaacgggaagcgccuggagcccaacugggccagcgugaagaaggaccucaucuccuacggcgggggcuggcggcugagcgcgcaguggcagaagggggaggaggugcaggucaucgccguggagcccggcaagaacccgaagaacuuccagaccaugcccggcaucuuccagaccaccacgggggagaucggcgccaucgcccuggacuucaagcccgggaccagcggcuccccgaucaucaaccgcgagggcaagguggucgggcuguacggcaacgggguggugaccaagaacggcggguacgucagcggcaucgcgcagaccaacgccgagcccgacggccccacgcccgagcucgaggaggagauguucaagaagcggaaccugaccaucauggaccugcacccgggguccggcaagacccgcaaguaccuccccgccaucgugcgggaggccaucaagcgccggcugcgcacccugauccucgcccccacgcggguggucgcggccgagauggaggaggcccugaaggggcugcccauccgcuaccagaccaccgccaccaagagcgagcacacgggccgggagaucguggaccucaugugccacgccaccuucaccaugcgccugcuguccccggugcggguccccaacuacaaccucgugaucauggacgaggcgcacuucaccgaccccgccagcaucgccgcccgcggguacaucuccacgcgggugggcaugggcgaggccgcggccaucuucaugaccgccacgccgcccgggaccgccgaggcguucccccagagcaacgcccccauccaggacgaggagcgcgacauccccgagcgcuccuggaacagcggcaacgaguggaucacggacuucgucgggaagaccgugugguucgugcccuccaucaaggccggcaacgacaucgccaacugccugcggaagaacgggaagaaggucauccagcugagccgcaagaccuucgacaccgaguaccagaagacgcggcucaacgacugggacuucguggugaccaccgacaucuccgagaugggcgccaacuucaaggcggaccgcgucaucgacccccggcgcugccugaagcccgugauccugaccgacggccccgagcgggugauccucgccgggccgaugcccgucacggccgccagcgccgcgcagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgccgcgaucgacggcgaguaccggcugaagggcgagagccgcaagaccuucgucgagcucaugcggcgcggggaccugcccguguggcuggcccacaagguggccuccgagggcaucaaguacacggaccggaaguggugcuucgacggggagcgcaacaaccagauccucgaggagaacauggacgucgagaucuggaccaaggagggcgagcggaagaagcugcgcccgcgcuggcuggacgcccggaccuacagcgacccccucgcgcugaaggaguucaaggacuucgccgccggccgcaaguccaucgcccuggaccucgugaccgagaucgggcgggugcccagccaccuggcccaccgcacgcggaacgcgcuggacaaccucgucaugcugcacaccagcgagcacggcgggcgcgccuaccggcacgccguggaggagcugccggagaccauggagacccuccugcugcucggccugaugauccugcucaccggcggggccaugcuguuccugaucuccgggaaggggaucggcaagaccagcaucgggcucaucugcgugaucgucuccagcggcaugcuguggauggccgacgugccccugcaguggaucgcguccgccaucgugcucgaguucuucaugaugguccugcugauccccgagcccgagaagcagcgcaccccgcaggacaaccagcucgccuacguggugaucgggauccugacccuggccgccaucgucgcggccaacgagaugggccuccuggagacgaccaagcgggaccugggcaugagcaaggagcccgggguggugucccccaccagcuaccucgacgucgaccugcaccccgccuccgccuggacccuguacgccguggcgacgaccgugaucaccccgaugcuccgccacaccaucgagaacagcacggccaacgucucccuggccgccaucgcgaaccaggccguggugcugaugggccucgacaagggguggcccaucagcaagauggaccugggcgucccccugcucgcccuggggugcuacucccaggugaacccccugacccucaccgccgccgugcugcugcucgucacccacuacgcgaucaucggcccgggccugcaggccaaggccacgcgggaggcccagaagcgcaccgccgcggggaucaugaagaaccccaccguggacggcaucaugaccaucgaccuggaccccgugaucuacgacagcaaguucgagaagcagcucgggcaggucaugcugcuggugcucugcgccgugcagcugcugcucaugcggacguccugggcccugugcgaggcccugacccucgccaccggccccaucaccacgcugugggagggcagcccggggaaguucuggaacaccaccaucgcggucuccauggccaacaucuuccgcggcagcuaccuggccggggccggccucgcguucuccaucaugaaguccguggggaccggccggcgcggcacggggagccagggcgagacccugggggagaaguggaagaagaagcugaaccagcucucccggaaggaguucgaccuguacaagaaguccggcaucaccgagguggaccgcaccgaggccaaggaggggcugaagcggggcgagaccacgcaccacgccgucucccgcggcagcgccaagcuccagugguucguggagcggaacauggugauccccgaggggcgcgucaucgaccugggcugcgggcgcggcgggugguccuacuacugcgccggccugaagaaggugaccgaggugcggggcuacaccaagggcggccccgggcacgaggagcccgucccgaugagcaccuacggcuggaacaucgugaagcucauguccgggaaggacguguucuaccugccgcccgagaagugcgacacgcugcugugcgacaucggcgagagcucccccagcccgaccgucgaggagucccgcaccauccgggugcucaagaugguggagcccuggcugcgcaacaaccaguucugcaucaagguccugaaccccuacaugcccaccgugaucgagcaccucgagcggcugcagcgcaaguacggcgggaugcuggugcggaacccgcucagccgcaacuccacgcacgagauguacuggaucagcaacggcaccgggaacaucgucuccagcgugaacauggucucccggcugcugcucaaccgcuucaccaugacccaccggcgccccacgaucgagaaggacguggaccugggcgcgggcacccggcacgugaacgccgagcccgagaccccgaacauggacgucaucggggagcgcaucaagcggaucaaggaggagcacagcuccaccuggcacuacgacgacgagaaccccuacaagacgugggccuaccacggcagcuacgaggugaaggccaccgggagcgccuccagcaugaucaacggcguggucaagcugcucaccaagcccugggacguggugcccauggucacccagauggcgaugacggacaccaccccguucgggcagcagcgcguguucaaggagaagguggacacccggacgccccgccccaugcccggcacccggaaggucauggagaucaccgccgaguggcuguggcgcacccugggccgcaacaagaagccgcggcucugcacgcgcgaggaguucaccaagaaggugcggaccaacgccgccaugggggccguguucaccgaggagaaccagugggacuccgcgcgcgccgccgucgaggacgaggaguucuggaagcugguggaccgggagcgcgagcugcacaagcucggcaagugcgggagcugcguguacaacaugaugggcaagcgggagaagaagcugggggaguucggcaaggccaagggcucccgcgcgaucugguacauguggcugggggcccgguaccucgaguucgaggcccugggcuuccugaacgaggaccacugguucagccgcgagaacuccuacagcggggucgagggcgaggggcuccacaagcugggcuacauccugcgggacaucuccaagauccccggcggggccauguacgccgacgacacggcgggcugggacacccgcaucaccgaggacgaccuccacaacgaggagaagaucacccagcagauggaccccgagcaccggcagcuggccaacgccaucuucaagcugacguaccagaacaagguggugaagguccagcgccccaccccgaaggggaccgugauggacaucaucagccggaaggaccagcgcggcuccggccagguggggaccuacggccucaacaccuucacgaacauggaggcccagcugguccggcagauggagggggagggcgugcugagcaaggccgaccucgagaacccccaccuccuggagaagaagaucacccaguggcucgagaccaaggggguggagcgccugaagcggauggcgaucuccggcgacgacugcgucgugaagcccaucgacgaccgcuucgccaacgcccugcucgcccugaacgacaugggcaaggugcggaaggacaucccccaguggcagccgagcaagggguggcacgacuggcagcagguccccuucugcucccaccacuuccacgagcugaucaugaaggacggccgcaagcucguggugcccugccgcccccaggacgagcugaucgggcgggcccgcaucagccagggcgcgggguggucccugaaggagaccgccugccucggcaaggccuacgcccagauguggaaccugauguacuuccaccggcgcgaccugcggcucgccagcaacgcgaucugcuccgccgucccggugcacuggauccccacgagccgcaccaccuggagcauccacgcccaccaccaguggaugaccacggaggacaugcugaccguguggaaccgggucuggaucgaggacaaccccuggauggaggacaagacccccgugaccacgugggaggacgugccguaccugggcaagcgcgaggaccaguggugcgggucccucaucggccugaccagccgggccaccugggcgcagaacauccugaccgccauccagcagguccgcucccucaucggggacgaggaguuccuggacuacaugcccagcaugaagcgguuccgcaaggaggaggaguccgagggcgccaucugguga

SEQ ID NO: 9975 - RNA, 9873 nt, Artificial Sequence
  derived and/or modified CDS sequence (opt1) from DENV-3__FJ639730__SS-prME
accagccugugccucaugaugaugcugcccgcgacccuggccuuccaccucaccagccgggacggcgagccccggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaagguggagaccugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgccaucaacuggaagggcaaggagcugaagugcggcuccgggaucuucgugaccaacgagguccacacguggaccgagcaguacaaguuccaggcggacagccccaagcgccuggccaccgccaucgccggcgccugggagaacggggugugcggcauccgcuccaccacgcggauggagaaccuccuguggaagcagaucgcgaacgagcugaacuacauccucugggagaacaacaucaagcugaccguggucgugggggacaucaucggcgugcuggagcagggcaagcgcacccucacgccccagccgauggagcugaaguacagcuggaagacgugggggaaggccaagaucgucaccgccgagacccagaacuccagcuucaucaucgacggccccaacacccccgagugccccuccgccagccgggcguggaacgugugggagguggaggacuacggguucggcgucuucacgaccaacaucuggcugaagcuccgcgagguguacacccagagcugcgaccaccggcugauguccgccgccaucaaggacgagaaggccgugcacgccgacaugggcuacuggaucgagagccagaagaacggguccuggaagcuggagaaggcgagcuucaucgaggucaagaccugcaccuggccgaagucccacacgcucuggagcaacggcgugcuggaguccgacaugaucauccccaagagccuggccgggcccaucucccagcacaaccaccgcccgggcuaccacacccagaccgccgggcccuggcaccucggcaagcuggagcuggacuucaacuacugcgagggcaccacgguggucaucaccgagaacugcgggacccggggccccagccuccgcaccacgaccguguccgggaagcugauccacgaguggugcugccggagcugcacccugcccccgcuccgcuacaugggcgaggacgggugcugguacggcauggagauccggcccaucaacgagaaggaggagaacauggugaagucccuggucagcgccggcuccgggaagguggacaacuucaccaugggcgugcugugccucgccauccuguucgaggaggucaugcgcgggaaguucggcaagaagcacaugaucgcgggggugcuguucacguucgugcuccugcugagcggccagaucaccuggcgggacauggcccacacccucaucaugaucggcuccaacgccagcgaccgcauggggaugggcgucaccuaccuggcccugaucgccacguucaagauccagcccuuccucgcgcugggguucuuccugcggaagcucaccagccgcgagaaccugcugcucggcgugggccuggccauggccaccacccugcagcuccccgaggacaucgagcagauggccaacgggaucgcgcugggccugaugacgcucaagcugaucacccaguucgagaccuaccagcuguggaccgcccucgugucccugacgugcagcaacaccaucuucacccugaccgucgccuggcggacggccacccucauccuggccggggugucccugcucccgcugugccagagcuccagcaugcgcaagaccgacuggcugcccaugaccgucgcggccaugggcgugccgccccugccgcuguucaucuucucccugaaggacacgcccaagcggcgcagcuggccccucaacgagggggugauggccgucggccugguguccauccuggccagcucccuccugcgcaacgacgugcccauggccggcccgcuggucgccggcgggcuccugaucgccugcuacgugaucaccgggaccagcgccgaccugaccguggagaaggccgccgacgucacgugggaggaggaggcggagcagaccggggugucccacaaccucaugaucaccguggacgacgacgggaccaugcggaucaaggacgacgagaccgagaacauccugacgguccugcucaagaccgcccugcugaucgugagcggcaucuuccccuacuccauccccgccacccuccugguguggcacaccuggcagaagcagacgcagcgcagcggcguccugugggacgugcccuccccgcccgagacccagaaggccgagcucgaggaggggguguaccggaucaagcagcagggcaucuucgggaagacccaggucggcgugggggugcagaaggagggcgucuuccacaccauguggcacgugacgcgcggcgccgugcugacccacaacgggaagcggcuggagcccaacugggcgagcgucaagaaggaccucaucuccuacggcgggggcuggcgccugaacgcccaguggcagaagggggaggagguccaggugaucgccgucgagcccggcaagaacccgaagaacuuccagaccaugcccggcaucuuccagaccacgaccggggagaucggcgccaucgcgcuggacuucaagcccgggaccagcggcagcccgaucaucaacaaggagggcaaggugguggggcuguacggcaacggggucgugaccaagaacggcggguacguguccggcaucgcccagacgaacgccgagcccgacggccccacccccgagcucgaggaggagauguucaagaagcggaaccugaccaucauggaccugcacccggggagcggcaagacccgcaaguaccuccccgccaucguccgggaggccaucaagcgccggcugcgcacgcugauccucgcgcccacccgggugguggccgccgagauggaggaggcccugaaggggcugcccauccgcuaccagaccaccgccacgaaguccgagcacaccggccgggagaucgucgaccucaugugccacgcgaccuucaccaugcgccugcugagcccggugcgggugcccaacuacaaccucgucaucauggacgaggcccacuucacggaccccgccuccaucgccgcccgcggguacaucagcacccgggugggcaugggcgaggcggccgccaucuucaugaccgccacgccgcccgggacggcggaggccuucccccaguccaacgcccccauccaggacgaggagcgcgacauccccgagcggagcuggaacuccggcaacgaguggaucaccgacuucguggggaagaccgucugguucgugcccagcaucaaggccggcaacgacaucgccaacugccugcgcaagaacgggaagaaggugauccagcugucccgcaagaccuucgacacggaguaccagaagacccggcucaacgacugggacuucgucgugaccaccgacaucagcgagaugggcgcgaacuucaaggccgaccgcgugaucgacccccggcgcugccugaagcccgucauccugacggacggccccgagcgggugauccucgccgggccgaugcccgugaccgccgccuccgcggcccagcgccggggccgcgucgggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagacguucguggagcucaugcggcgcggggaccugcccgucuggcuggcccacaagguggccagcgagggcaucaaguacaccgaccggaaguggugcuucgacggggagcgcaacaaccagauccucgaggagaacauggacguggagaucuggaccaaggagggcgagcggaagaagcugcgcccgcgguggcuggacgcgcgcaccuacuccgacccccucgcccugaaggaguucaaggacuucgccgccggccgcaagagcaucgcccuggaccucgucacggagaucgggcgggugcccucccaccuggcgcaccgcacccggaacgcccuggacaaccucgugaugcugcacaccagcgagcacggcgggcgcgccuaccggcacgccgucgaggagcugccggagaccauggagacgcuccugcugcucggccugaugauccugcucaccgggggcgccaugcuguuccugaucagcggcaaggggaucggcaagaccuccaucgggcucaucugcgugaucgugagcuccggcaugcuguggauggcggacgucccccugcaguggaucgccagcgccaucgugcucgaguucuucaugauggugcugcugauccccgagcccgagaagcagcgcaccccgcaggacaaccagcucgccuacgucgugaucgggauccugacgcuggccgcgaucguggccgccaacgagaugggccuccuggagaccaccaagcgggaccugggcauguccaaggagcccggggucgugagccccaccuccuaccucgacguggaccugcaccccgccagcgccuggacgcuguacgcggucgccaccaccgugaucaccccgaugcuccgccacacgaucgagaacuccaccgccaacgugagccuggccgcgaucgccaaccaggccgucgugcugaugggccucgacaagggguggcccaucuccaagauggaccugggcgugccccugcucgcccuggggugcuacagccaggucaacccccugacccucaccgccgcggugcugcugcucgugacgcacuacgccaucaucggcccgggccugcaggccaaggccacccgggaggcccagaagcgcaccgcggccgggaucaugaagaaccccaccgucgacggcaucaugacgaucgaccuggaccccgugaucuacgacuccaaguucgagaagcagcucggccaggugaugcugcugguccucugcgccgugcagcugcugcucaugcggaccagcugggcccugugcgaggcccugacccucgcgaccggccccaucacgacccugugggagggcuccccggggaaguucuggaacaccaccaucgccgugagcauggccaacaucuuccgcggcuccuaccuggccggggcgggccucgccuucagcaucaugaaguccgucgggacgggccggcgcggcaccgggagccagggcgagacccugggggagaaguggaagaagaagcugaaccagcucagccggaaggaguucgagcuguacaagaaguccggcaucaccgagguggaccgcaccgaggccaaggaggggcugaagcggggcgagacgacccaccacgccgugagccgcggcuccgccaagcuccagugguucgucgagcggaacauggugauccccgaggggcgcgugaucgaccugggcugcgggcggggcggguggagcuacuacugcgcgggccugaagaaggucaccgaggugcgcggcuacaccaagggcgggcccgggcacgaggagcccgugccgauguccacguacggcuggaacaucgucaagcucaugagcgggaaggacguguucuaccugccgcccgagaagugcgacacccugcugugcgacaucggcgaguccagccccuccccgaccguggaggagagccgcaccauccggguccucaagaugguggagcccuggcugcgcaacaaccaguucugcaucaaggugcugaaccccuacaugcccacggucaucgagcaccucgagaagcugcagcggaaguacggcgggaugcuggugcgcaacccgcucucccggaacagcacccacgagauguacuggaucuccaacggcaccgggaacaucgugagcuccgucaacauggugagccgccugcugcucaaccgguucaccaugacgcaccgccggcccaccaucgagaaggacgucgaccugggcgccggcacccgccacgugaacgccgagcccgagaccccgaacauggacgugaucggggagcggaucaagcgcaucaaggaggagcacuccagcacguggcacuacgacgacgagaaccccuacaagaccugggccuaccacggcuccuacgaggucaaggccaccgggagcgcgagcuccaugaucaacggcguggugaagcugcucaccaagcccugggacgucgugcccauggugacgcagauggccaugaccgacaccaccccguucgggcagcagcgggucuucaaggagaagguggacacgcgcacgccccggcccaugcccggcacccgcaaggugauggagaucaccgccgaguggcuguggcggacgcugggccgcaacaagaagccgcggcucugcacccgcgaggaguucaccaagaagguccgcaccaacgccgccaugggggcgguguucacggaggagaaccagugggacagcgcccgggccgccguggaggacgaggaguucuggaagcuggucgaccgcgagcgggagcugcacaagcucggcaagugcggguccugcguguacaacaugaugggcaagcgcgagaagaagcugggggaguucggcaaggcgaagggcagccgggccaucugguacauguggcugggggcccgcuaccucgaguucgaggcccugggcuuccugaacgaggaccacugguucucccgggagaacagcuacuccgggguggagggcgaggggcuccacaagcugggcuacauccugcgcgacaucagcaagauccccggcggggccauguacgcggacgacaccgccggcugggacacccggaucaccgaggacgaccuccacaacgaggagaagaucacgcagcagauggaccccgagcaccgccagcuggccaacgccaucuucaagcugaccuaccagaacaaggucgugaaggugcagcggcccaccccgaaggggaccgucauggacaucaucucccgcaaggaccagcggggcagcggccagguggggaccuacggccucaacacguucaccaacauggaggcccagcuggugcgccagauggagggggagggcguccuguccaaggcggaccucgagaacccccaccuccuggagaagaagaucacccaguggcucgagaccaaggggguggagcggcugaagcgcauggccaucagcggcgacgacugcguggucaagcccaucgacgaccgguucgccaacgcccugcucgcccugaacgacaugggcaaggugcgcaaggacaucccccaguggcagccguccaagggguggcacgacuggcagcagguccccuucugcagccaccacuuccacgagcugaucaugaaggacggccggaagcucgucgugcccugccgcccccaggacgagcugaucgggcgggcgcgcaucucccagggcgccggguggagccugaaggagacggccugccucggcaaggccuacgcccagauguggucccugauguacuuccaccgccgggaccugcgccucgcgagcaacgccaucugcuccgccgugccgguccacuggauccccaccagccggaccaccuggagcauccacgcccaccaccaguggaugacgaccgaggacaugcugaccguguggaaccgcguguggaucgaggacaaccccuggauggaggacaagacccccgucacgaccugggaggacgugccguaccugggcaagcgggaggaccaguggugcgggucccucaucggccugaccagccgcgcgaccugggcccagaacauccugacggccauccagcagguccggucccucaucggggacgaggaguuccuggacuacaugcccagcaugaagcgcuuccggaaggaggaggaguccgagggcgccaucugguga

SEQ ID NO: 9976 - RNA, 9873 nt, Artificial Sequence
  derived and/or modified CDS sequence (opt1) from DENV-3__KF955464__SS-prME
accagccugugccucaugaugaugcugcccgcgacccuggccuuccaccucaccagccgggacggcgagccccggaugaucguggggaagaacgagcgcggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgauccugcggaagcugugcaucgagggcaagaucacgaacaucaccaccgacucccgcugccccacccagggcgaggccacgcucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccuccaccguggaggccgugcugcccgaguacggcacccucgggcuggagugcagcccgcgcaccggccuggacuucaacgagaugauccuccugaccaugaagaacaaggcguggaugguccaccggcagugguucuucgaccugccccuccccuggacguccggcgccaccaccgagacccccacguggaaccgcaaggagcugcuggugaccuucaagaacgcccacgccaagaagcaggagguggucgugcucgggagccaggagggcgccaugcacaccgcgcugaccggggccacggagauccagaacuccggcgggaccaacaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccaucaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgugggcgggguccugaacagccucggcaagauggugcaccagaucuucggguccgcguacaccgcccuguucagcggcguguccuggaucaugaagaucggcaucgggguccugcucaccuggaucggccugaacagcaagaacacguccaugagcuucuccugcaucgugaucgggaucaucacccuguaccucggcgccgugguccaggccgacauggggugcgugaucaacuggaagggcaaggagcugaagugcggcaacgggaucuucgugaccaacgagguccacaccuggacggagcaguacaaguuccaggccgacagccccaagcgccuggcgaccgccaucgccggcgccugggagaacggggugugcggcauccgcuccaccacccggauggagaaccuccuguggaagcagaucgccaacgagcugaacuacauccucugggagaacaacaucaagcugacgguggucgugggggacaucaucggcgugcuggagcagggcaagcgcacccucacgccccagccgauggagcugaaguacagcuggaagaccugggggaaggcgaagaucgucacggccgagacccagaacuccagcuucaucaucgacggccccaacacccccgagugccccuccgccagccgggccuggaacgugugggagguggaggacuacggguucggcgucuucaccacgaacaucuggcugaagcuccgcgagguguacacccaguccugcgaccaccggcugaugagcgcggccaucaaggacgagcgcgccgugcacgccgacaugggcuacuggaucgagagccagaagaacggguccuggaagcuggagaaggccagcuucaucgaggucaagaccugcaccuggccgaagucccacacccucuggagcaacggcgugcuggaguccgacaugaucauccccaagagccuggcggggcccaucucccagcacaaccaccggccgggcuaccacacgcagaccgccgggcccuggcaccucggcaagcuggagcuggacuucaacuacugcgagggcaccaccguggucaucgccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucaacgagaaggaggagaacauggugaagucccuggucagcgccggcuccgggaagguggacaacuucaccaugggcgugcugugccucgccauccuguucgaggaggucaugcgggggaaguucggcaagaagcacaugaucgcgggggugcuguucaccuucgugcuccugcugagcggccagaucaccuggcgcgacauggcccacacgcucaucaugaucggcuccaacgccagcgaccggauggggaugggcgucaccuaccuggcccugaucgccaccuucaagauccagcccuuccucgcgcugggguucuuccugcgcaagcucaccucccgggagaaccugcugcucggcgugggccuggccauggccacgacccugcagcuccccgaggacaucgagcagauggccaacgggaucgcgcugggccugaugacccucaagcugaucacccaguucgagacguaccagcuguggaccgcccucgugagccugaccugcagcaacaccaucuucacgcugaccgucgccuggcgcaccgccacccucauccuggccggggugucccugcucccgcugugccagagcuccagcaugcggaagacggacuggcugcccaugaccgucgcggccaugggcgugccgccccugccgcuguucaucuucucccugaaggacacccccaagcgcaagagcuggccccucaacgagggggugauggccgucggccugguguccauccuggccagcucccuccugcgcaacgacgugcccauggccggcccgcuggucgccggcgggcuccugaucgccugcuacgugaucaccgggacgagcgccgaccugaccguggagaaggccgccgacgucaccugggaggaggaggcggagcagaccggggugucccacaaccucaugaucacgguggacgacgacgggaccaugcggaucaaggacgacgagaccgagaacauccugaccguccugcucaagaccgcccugcugaucgugagcggcaucuuccccuacuccauccccgccacgcuccugguguggcacaccuggcagaagcagacccagcgcagcggcguccugugggacgugcccuccccgcccgagacccagaaggccgagcucgaggaggggguguaccggaucaagcagcagggcaucuucgggaagacgcaggucggcgugggggugcagaaggagggcgucuuccacaccauguggcacgugacccgcggcgccgugcugacccacaacgggaagcggcuggagcccaacugggcgagcgucaagaaggaccucaucuccuacggcgggggcuggcgccugagcgcccaguggcagaagggggaggagguccaggugaucgccgucgagcccggcaagaacccgaagaacuuccagacgaugcccggcaucuuccagaccaccaccggggagaucggcgccaucgcgcuggacuucaagcccgggacguccggcagcccgaucaucaaccgggagggcaaggugguggggcuguacggcaacggggucgugaccaagaacggcggguacgugagcggcaucgcccagaccaacgccgagcccgacggccccacccccgagcucgaggaggagauguucaagaagcgcaaccugacgaucauggaccugcacccgggguccggcaagacccggaaguaccuccccgccaucguccgcgaggccaucaagcggcgccugcggacccugauccucgcgcccacccgcgugguggccgccgagauggaggaggcccugaaggggcugcccauccgguaccagacgaccgccaccaagagcgagcacaccggccgcgagaucgucgaccucaugugccacgcgacguucaccaugcggcugcuguccccggugcgcgugcccaacuacaaccucaucaucauggacgaggcccacuucaccgaccccgccagcaucgccgcccggggguacaucuccacccgcgucggcaugggcgaggcggccgccaucuucaugacggccacgccgcccgggaccgcggaggccuucccccagagcaacgcccccauccaggacgaggagcgggacauccccgagcgcuccuggaacagcggcaacgaguggaucaccgacuucguggggaagacggugugguucguccccuccaucaaggccggcaacgacaucgccaacugccugcgcaagaacgggaagaaggugauccagcugagccggaagaccuucgacaccgaguaccagaagacccgccucaacgacugggacuucguggucacgaccgacaucuccgagaugggcgcgaacuucaaggccgaccgggugaucgacccccgccggugccugaagcccgugauccugaccgacggccccgagcgcgucauccucgccgggccgaugcccgugaccgccgccagcgcggcccagcggcgcggccggguggggcgcaacccccagaaggagaacgaccaguacaucuucacgggccagccccugaacaacgacgaggaccacgcccacuggaccgaggccaagaugcugcucgacaacaucaacaccccggaggggaucauccccgcccuguucgagcccgagcgggagaaguccgcggccaucgacggcgaguaccgccugaagggcgagagccggaagaccuucgucgagcucaugcgccgcggggaccugcccguguggcuggcccacaaggucgccuccgagggcaucaaguacaccgaccgcaaguggugcuucgacggggagcggaacaaccagauccucgaggagaacauggacguggagaucuggacgaaggagggcgagcgcaagaagcugcggccgcgcuggcuggacgcgcgcaccuacagcgacccccucgcccugaaggaguucaaggacuucgccgccggccggaaguccaucgcccuggaccucgugaccgagaucgggcgcguccccagccaccuggcgcaccggacccgcaacgcccuggacaaccucgugaugcugcacacguccgagcacggcgggcgggccuaccgccacgccguggaggagcugccggagaccauggagacccuccugcugcucggccugaugauccugcucaccgggggcgccaugcuguuccugaucagcggcaaggggaucggcaagacgagcaucgggcucaucugcgucaucguguccagcggcaugcuguggauggcggacgugccccugcaguggaucgccuccgccaucguccucgaguucuucaugauggugcugcugauccccgagcccgagaagcagcggaccccgcaggacaaccagcucgccuacguggucaucgggauccugacccuggccgcgaucguggccgccaacgagaugggccuccuggagaccacgaagcgcgaccugggcaugagcaaggagcccgggguggucucccccaccagcuaccucgacguggaccugcaccccgccuccgccuggacccuguacgcgguggccaccacggucaucaccccgaugcuccggcacaccaucgagaacagcaccgccaacgugucccuggccgcgaucgccaaccaggccgugguccugaugggccucgacaagggguggcccaucagcaagauggaccugggcgugccccugcucgcccuggggugcuacucccaggugaacccccugacgcucaccgccgcgguccugcugcucgugacccacuacgccaucaucggcccgggccugcaggccaaggccacccgcgaggcccagaagcggacggcggccgggaucaugaagaaccccaccguggacggcaucaugaccaucgaccuggaccccgucaucuacgacagcaaguucgagaagcagcucggccaggugaugcugcuggugcucugcgccguccagcugcugcucaugcgcaccuccugggcccugugcgaggcccugacgcucgcgaccggccccaucaccacccugugggagggcagcccggggaaguucuggaacacgaccaucgccguguccauggccaacaucuuccggggcagcuaccuggccggggcgggccucgccuucuccaucaugaaguccguggggaccggccgccggggcaccgggucccagggcgagacgcugggggagaaguggaagaagaagcugaaccagcucagccgcaaggaguucgaccuguacaagaaguccggcaucaccgaggucgaccggaccgaggccaaggaggggcugaagcgcggcgagaccacccaccacgccgugucccggggcagcgccaagcuccagugguucguggagcgcaacauggucauccccgaggggcgggugaucgaccugggcugcgggcgcggcgggugguccuacuacugcgcgggccugaagaaggugacggagguccgcggcuacaccaagggcgggcccgggcacgaggagcccgugccgaugagcaccuacggcuggaacaucgugaagcucauguccgggaaggacgucuucuaccugccgcccgagaagugcgacacccugcugugcgacaucggcgagagcucccccagcccgacgguggaggagucccggaccauccgcgugcuccggauggucgagcccuggcugcgcaacaaccaguucugcaucaaggugcugaaccccuacaugcccaacgugaucgagcaccucgagcggcugcagcgcaaguacggcgggaugcugguccggaacccgcucagccgcaacuccacccacgagauguacuggaucagcaacggcaccgggaacaucguguccagcgugaacauggucucccggcugcugcucaaccgcuucacgaugacccaccggcgccccaccaucgagaaggacguggaccugggcgccggcacccggcacgucaacgccgagcccgagacgccgaacauggacgugaucggggagcgcaucaagcggaucaaggaggagcacagcuccaccuggcacuacgacgacgagaaccccuacaagaccugggccuaccacggcagcuacgaggugaaggccaccggguccgcgagcagcaugaucaacggcgucgugaagcugcucacgaagcccugggacgugguccccauggugacccagauggccaugaccgacaccacgccguucgggcagcagcgcguguucaaggagaaggucgacacccggacgccccggcccaugcccggcacccggaaggugauggagaucacggccgaguggcuguggcgcacccugggccgcaacaagaagccgcggcucugcacccgcgaggaguucaccaagaaggugcggacgaacgccgccaugggggcggucuucaccgaggagaaccagugggacuccgcccgcgccgccguggaggacgaggaguucuggaagcugguggacaaggagcgggagcugcacaagcucggcaagugcgggagcugcgucuacaacaugaugggcaagcgcgagaagaagcugggggaguucggcaaggcgaagggcucccgggccaucugguacauguggcugggggcccgcuaccucgaguucgaggcccugggcuuccugaacgaggaccacugguucagccgggagaacuccuacagcgggguggagggcgaggggcuccacaagcugggcuacauccugcgcgacaucuccaagauccccggcggggccauguacgcggacgacaccgccggcugggacacccggaucacggaggacgaccuccacaacgaggagaagaucacccagcagauggaccccgagcaccgccagcuggccaacgccaucuucaagcugaccuaccagaacaagguggucaaggugcagcggcccaccccgaaggggacggugauggacaucaucagccgcaaggaccagcggggcuccggccaggucgggaccuacggccucaacaccuucaccaacauggaggcccagcuggugcgccagauggagggggagggcgugcugagcgaggcggaccucgagaacccccaccuccuggagaagaagaucacccaguggcucgagacgaagggggucgagcggcugaagcgcauggccaucuccggcgacgacugcguggugaagcccaucgacgaccgguucgccaacgcccugcucgcccugaacgacaugggcaagguccgcaaggacaucccccaguggcagccgagcaagggguggcacgacuggcagcagguccccuucugcucccaccacuuccacgagcugaucaugaaggacggccggaagcucgugguccccugccgcccccaggacgagcugaucgggcgcgcgcggaucagccagggcgccggguggucccugaaggagaccgccugccucggcaaggccuacgcccagauguggagccugauguacuuccaccgccgggaccugcgccucgcguccaacgccaucugcagcgccgugccggcccacuggauccccaccucccggaccacguggagcauccacgcgcaccaccaguggaugaccaccgaggacaugcugaccguguggaaccgcgucuggaucgaggacaaccccuggauggaggacaagacgcccgugaccaccugggaggacgugccguaccugggcaagcgggaggaccaguggugcgggagccucaucggccugaccucccgcgccacgugggcccagaacauccugaccgccauccagcagguccggagccucaucggggacgaggaguuccuggacuacaugcccuccaugaagcgcuuccggaaggaggaggagagcgagggcgccaucugguga

SEQ ID NO: 9977 - RNA, 9873 nt, Artificial Sequence
  derived and/or modified CDS sequence (opt1) from DENV-3__FJ639731__SS-prME
accagccugugccucaugaugaugcugcccgcgacccuggccuuccaccucaccagccgggacggcgagccccggaugaucguggggaagaacgagcggggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgggacaagcgguccguggcccuggcgccccacgugggcauggggcuggacacccgcacccagaccuggaugagcgccgagggcgccuggcgccagguggagaagguggagaccugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccgugcugaucaagguggaguacaagggcgaggacgccccgugcaagauccccuucagcaccgaggacgggcagggcaaggcgcacaacggccgccugaucaccgccaaccccgucgugacgaagaaggaggagcccgugaacaucgaggccgagccgcccuucggggaguccaacaucgucaucggcaucggggacaaggcccucaagaucaacugguacaagaagggcagcuccaucgggaagauguucgaggcgaccgcccggggcgcccgccggauggccauccugggcgacaccgccugggacuucgggagcgugggcggggugcugaacucccucggcaagaugguccaccagaucuucgggagcgcguacaccgcccuguucuccggcgugagcuggaucaugaagaucggcaucggggugcugcucacguggaucggccugaacuccaagaacaccagcauguccuucagcugcaucgucaucgggaucaucacccuguaccucggcgccguggugcaggccgacauggggugcgccaucaacuggaagggcaaggagcugaagugcggcuccgggaucuucgucaccaacgaggugcacacguggaccgagcaguacaaguuccaggcggacagccccaagcgccuggccaccgccaucgccggcgccugggagaacggggugugcggcauccgcuccaccacgcggauggagaaccuccuguggaagcagaucgcgaacgagcugaacuacauccucugggagaacaacaucaagcugaccgucguggugggggacaucaucggcguccuggagcagggcaagcgcacccucacgccccagccgauggagcugaaguacagcuggaagacgugggggaaggccaagaucgugaccgccgagacccagaacuccagcuucaucaucgacggccccaacacccccgagugccccuccgccagccgggcguggaacgugugggaggucgaggacuacggguucggcguguucacgaccaacaucuggcugaagcuccgcgagguguacacccagagcugcgaccaccggcugauguccgccgccaucaaggacgagcgcgccguccacgccgacaugggcuacuggaucgagagccagaagaacggguccuggaagcuggagaaggcgagcuucaucgaggugaagaccugcaccuggccgaagucccacacgcucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcaccacggucgugaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucaacgagaaggaggagaacauggucaagucccuggugagcgccggcuccgggaagauggacaacuucaccaugggcgugcugugccucgccauccuguucgaggaggucaugcgggggaaguucggcaagaagcacaugaucgcgggggugcuguucacguucgugcuccugcugagcggccagaucaccuggcgcgacauggcccacacccucaucaugaucggcuccaacgccagcgaccggauggggaugggcgucaccuaccuggcccugaucgccacguucaagauccagcccuuccucgcgcugggguucuuccugcgcaagcucaccagccgggagaaccugcugcucggcgugggccuggccauggccaccacccugcagcuccccgaggacaucgagcagauggccaacgggaucgcgcugggccugaugacgcucaagcugaucacccaguucgagaccuaccagcuguggaccgcccucgugucccugacgugcagcaacaccaucuucacccugaccgucgccuggcgcacggccacccucauccuggccggggugucccugcucccgcugugccagagcuccagcaugcggaagaccgacuggcugcccaugaccgucgcggccaugggcgugccgccccugccgcuguucaucuucucccugaaggacacgcccaagcgccgcagcuggccccucaacgagggggugauggccgucggccugguguccauccuggccagcucccuccugcggaacgacgugcccauggccggcccgcuggucgccggcgggcuccugaucgccugcuacgugaucaccgggaccagcgccgaccugaccguggagaaggccgccgacgucacgugggaggaggaggcggagcagaccggggugucccacaaccucaugaucaccguggacgacgacgggaccaugcgcaucaaggacgacgagaccgagaacauccugacgguccugcucaagaccgcccugcugaucgugagcggcaucuuccccuacuccauccccgccacccuccugguguggcacaccuggcagaagcagacgcagcggagcggcguccugugggacgugcccuccccgcccgagacccagaaggccgagcucgaggaggggguguaccgcaucaagcagcagggcaucuucgggaagacccaggucggcgugggggugcagaaggagggcgucuuccacaccauguggcacgugacgcggggcgccgugcugacccacaacgggaagcgccuggagcccaacugggcgagcgucaagaaggaccucaucuccuacggcgggggcuggcggcugaacgcccaguggcagaagggggaggagguccaggugaucgccgucgagcccggcaagaacccgaagaacuuccagaccaugcccggcaucuuccagaccacgaccggggagaucggcgccaucgcgcuggacuucaagcccgggaccagcggcagcccgaucaucaacaaggagggcaaggugguggggcuguacggcaacggggucgugaccaagaacggcggguacguguccggcaucgcccagacgaacgccgagcccgacggccccacccccgagcucgaggaggagauguucaagaagcgcaaccugaccaucauggaccugcacccggggagcggcaagacccggaaguaccuccccgccaucguccgcgaggccaucaagcggcgccugcggacgcugauccucgcgcccacccgcgugguggccgccgagauggaggaggcccugaaggggcugcccauccgguaccagaccaccgccacgaaguccgagcacaccggccgcgagaucgucgaccucaugugccacgcgaccuucaccaugcggcugcugagcccggugcgcgugcccaacuacaaccucgucaucauggacgaggcccacuucacggaccccgccuccaucgccgcccggggguacaucagcacccgcgugggcaugggcgaggcggccgccaucuucaugaccgccacgccgcccgggacggcggaggccuucccccaguccaacgcccccauccaggacgaggagcgggacauccccgagcgcagcuggaacuccggcaacgaguggaucaccgacuucguggggaagaccgucugguucgugcccagcaucaaggccggcaacgacaucgccaacugccugcgcaagaacgggaagaaggugauccagcugucccggaagaccuucgacacggaguaccagaagacccgccucaacgacugggacuucgucgugaccaccgacaucagcgagaugggcgcgaacuucaaggccgaccgggugaucgacccccgccggugccugaagcccgucauccugacggacggccccgagcgcgugauccucgccgggccgaugcccgugaccgccgccuccgcggcccagcggcgcggccgggucgggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgcggccaucgacggcgaguaccgccugaagggcgagucccggaagacguucguggagcucaugcgccgcggggaccugcccgucuggcuggcccacaagguggccagcgagggcaucaaguacaccgaccgcaaguggugcuucgacggggagcggaacaaccagauccucgaggagaacauggacguggagaucuggaccaaggagggcgagcgcaagaagcugcggccgcgcuggcuggacgcgcgcaccuacuccgacccccucgcccugaaggaguucaaggacuucgccgccggccgcaagagcaucgcccuggaccucgucacggagaucgggcgcgugcccucccaccuggcgcaccggacccgcaacgcccuggacaaccucgugaugcugcacaccagcgagcacggcgggcgggccuaccgccacgccgucgaggagcugccggagaccauggagacgcuccugcugcucggccugaugauccugcucaccgggggcgccaugcuguuccugaucagcggcaaggggaucggcaagaccuccaucgggcucaucugcgugaucgugagcuccggcaugcuguggauggcggacgucccccugcaguggaucgccagcgccaucgugcucgaguucuucaugauggugcugcugauccccgagcccgagaagcagcggaccccgcaggacaaccagcucgccuacgucgugaucgggauccugacgcuggccgcgaucguggccgccaacgagaugggccuccuggagaccaccaagcgcgaccugggcauguccaaggagcccggggucgugagccccaccuccuaccucgacguggaccugcaccccgccagcgccuggacgcuguacgcggucgccaccaccgugaucaccccgaugcuccggcacacgaucgagaacuccaccgccaacgugagccuggccgcgaucgccaaccaggccgucgugcugaugggccucgacaagggguggcccaucuccaagauggaccugggcgugccccugcucgcccuggggugcuacagccaggucaacccccugacccucaccgccgcggugcugcugcucgugacgcacuacgccaucaucggcccgggccugcaggccaaggccacccgcgaggcccagaagcggaccgcggccgggaucaugaagaaccccaccgucgacggcaucaugacgaucgaccuggaccccgugaucuacgacuccaaguucgagaagcagcucggccaggugaugcugcugguccucugcgccgugcagcugcugcucaugcgcaccagcugggcccugugcgaggcccugacccucgcgaccggccccaucacgacccugugggagggcuccccggggaaguucuggaacaccaccaucgccgugagcauggccaacaucuuccggggcuccuaccuggccggggcgggccucgccuucagcaucaugaaguccgucgggacgggccgccggggcaccgggagccagggcgagacccugggggagaaguggaagaagaagcugaaccagcucagccgcaaggaguucgaccuguacaagaaguccggcaucaccgagguggaccggaccgaggccaaggaggggcugaagcgcggcgagacgacccaccacgccgugagccggggcuccgccaagcuccagugguucgucgagcgcaacauggugauccccgaggggcgggugaucgaccugggcugcgggcgcggcggguggagcuacuacugcgcgggccugaagaaggucaccgaggugcgcggcuacaccaagggcgggcccgggcacgaggagcccgugccgauguccacguacggcuggaacaucgucaagcucaugagcgggaaggacguguucuaccugccgcccgagaagugcgacacccugcugugcgacaucggcgaguccagccccuccccgaccguggaggagagccggaccauccgcguccucaagaugguggagcccuggcugcggaacaaccaguucugcaucaaggugcugaaccccuacaugcccacggucaucgagcaccucgagcgccugcagcggaaguacggcgggaugcuggugcgcaacccgcucucccggaacagcacccacgagauguacuggaucuccaacggcaccgggaacaucgugagcuccgucaacauggugagccgccugcugcucaaccgguucaccaugacgcaccgccggcccaccaucgagaaggacgucgaccugggcgccggcacccgccacgugaacgccgagcccgagaccccgaacauggacgugaucggggagcggaucaagcgcaucaaggaggagcacuccagcacguggcacuacgacgacgagaaccccuacaagaccugggccuaccacggcuccuacgaggucaaggccaccgggagcgcgagcuccaugaucaacggcguggugaagcugcucaccaagcccugggacgucgugcccauggugacgcagauggccaugaccgacaccaccccguucgggcagcagcgggucuucaaggagaagguggacacgcgcacgccccggcccaugcccggcacccgcaaggugauggagaucaccgccgaguggcuguggcggacgcugggccgcaacaagaagccgcgccucugcacccgggaggaguucaccaagaagguccgcaccaacgccgccaugggggcgguguucacggaggagaaccagugggacagcgcccgggccgccguggaggacgaggaguucuggaagcuggucgaccgcgagcgggagcugcacaagcucggcaagugcggguccugcguguacaacaugaugggcaagcgcgagaagaagcugggggaguucggcaaggcgaagggcagccgggccaucugguacauguggcugggggcccgcuaccucgaguucgaggcccugggcuuccugaacgaggaccacugguucucccgggagaacagcuacuccgggguggagggcgaggggcuccacaagcugggcuacauccugcgcgacaucagcaagauccccggcggggccauguacgcggacgacaccgccggcugggacacccggaucaccgaggacgaccuccacaacgaggagaagaucacgcagcagauggaccccgagcaccgccagcuggccaacgccaucuucaagcugaccuaccagaacaaggucgugaaggugcagcggcccaccccgaaggggaccgucauggacaucaucucccgcaaggaccagcggggcagcggccagguggggaccuacggccucaacacguucaccaacauggaggcccagcuggugcgccagauggagggggagggcguccuguccaaggcggaccucgagaacccccaccuccuggagaagaagaucacccaguggcucgagaccaaggggguggagcggcugaagcgcauggccaucagcggcgacgacugcguggucaagcccaucgacgaccgguucgccaacgcccugcucgcccugaacgacaugggcaaggugcgcaaggacaucccccaguggcagccguccaagggguggcacgacuggcagcagguccccuucugcagccaccacuuccacgagcugaucaugaaggacggccggaagcucgucgugcccugccgcccccaggacgagcugaucgggcgcgcgcggaucucccagggcgccggguggagccugaaggagacggccugccucggcaaggccuacgcccagauguggucccugauguacuuccaccgccgggaccugcgccucgcgagcaacgccaucugcuccgccgugccgguccacuggauccccaccagccggaccaccuggagcauccacgcccaccaccaguggaugacgaccgaggacaugcugaccguguggaaccgcguguggaucgaggacaaccccuggauggaggacaagacccccgucacgaccugggaggacgugccguaccugggcaagcgggaggaccaguggugcgggucccucaucggccugaccagccgcgcgaccugggcccagaacauccugacggccauccagcagguccggucccucaucggggacgaggaguuccuggacuacaugcccagcaugaagcgcuuccggaaggaggaggaguccgagggcgccaucugguga

SEQ ID NO: 9978 - RNA, 9873 nt, Artificial Sequence
  derived and/or modified CDS sequence (opt1) from DENV-3__HM181933__SS-prME
accagccugugccucaugaugaugcugcccgccacccuggccuuccaccucaccagccgggacggcgagccccggaugaucguggggaagaacgagcggggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgggacaagcgguccguggcccuggcgccccacgugggcauggggcuggacacccgcacccagaccuggaugagcgccgagggcgccuggcgccagguggagaagguggagaccugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgccaucaacuggaagggcaaggagcugaagugcggcuccgggaucuucgugaccaacgagguccacacguggaccgagcaguacaaguuccaggcggacagccccaagcgccuggccaccgccaucgccggcgccugggagaacggggugugcggcauccgcuccaccacgcggauggagaaccuccuguggaagcagaucgcgaacgagcugaacuacauccucugggagaacaacaucaagcugaccguggucgugggggacaucaucggcgugcuggagcagggcaagcgcacccucacgccccagccgauggagcugaaguacagcuggaagacgugggggaaggccaagaucgucaccgccgagacccagaacuccagcuucaucaucgacggccccaacacccccgagugccccuccgccagccgggcguggaacgugugggagguggaggacuacggguucggcgucuucacgaccaacaucuggcugaagcuccgcgagguguacacccagagcugcgaccaccggcugauguccgccgccaucaaggacgagcgcgccgugcacgccgacaugggcuacuggaucgagagccagaagaacggguccuggaagcuggagaaggcgagcuucaucgaggucaagaccugcaccuggccgaagucccacacgcucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcaccacgguggucaucaccgagaacugcgggacccgccggcccagccuccgcaccacgaccguguccggcaagcugauccacgaguggugcugccggagcugcacccugcccccgcuccgcuacaugggggaggacggcugcugguacgggauggagauccggcccaucaacgagaaggaggagaacauggugaagucccuggucagcgccggcuccggcaagguggacaacuucaccaugggggugcugugccucgccauccuguucgaggaggucaugcgcggcaaguucgggaagaagcacaugaucgcgggcgugcuguucacguucgugcuccugcugagcgggcagaucaccuggcgggacauggcccacacccucaucaugaucggcuccaacgccagcgaccgcaugggcaugggggucaccuaccuggcccugaucgccacguucaagauccagcccuuccucgcgcugggcuucuuccugcggaagcucaccagccgcgagaaccugcugcucggggugggccuggccauggccaccacccugcagcuccccgaggacaucgagcagauggccaacggcaucgcgcuggggcugaugacgcucaagcugaucacccaguucgagaccuaccagcuguggaccgcccucgugucccugacgugcagcaacaccaucuucacccugaccgucgccuggcggacggccacccucauccuggccggcgugucccugcucccgcugugccagagcuccagcaugcgcaagaccgacuggcugcccaugaccgucgcggccaugggggugccgccccugccgcuguucaucuucucccugaaggacacgcccaagcgccggagcuggccccucaacgagggcgugauggccgucgggcugguguccauccuggccagcucccuccugcgcaacgacgugcccauggccggcccgcuggucgcgggcgggcuccugaucgccugcuacgugaucaccggcaccagcgccgaccugaccguggagaaggccgccgacgucacgugggaggaggaggcggagcagaccggggugucccacaaccucaugaucaccguggacgacgacggcaccaugcggaucaaggacgacgagaccgagaacauccugacgguccugcucaagaccgcccugcugaucgugagcgggaucuuccccuacuccauccccgccacccuccugguguggcacaccuggcagaagcagacgcagcgcagcggcguccugugggacgugcccuccccgcccgagacccagaaggccgagcucgaggagggcguguaccggaucaagcagcaggggaucuucggcaagacccaggucggggugggcgugcagaaggagggggucuuccacaccauguggcacgugacgcgcggcgccgugcugacccacaacggcaagcggcuggagcccaacugggcgagcgucaagaaggaccucaucuccuacgggggcggguggcgccugaacgcccaguggcagaagggcgaggagguccaggugaucgccgucgagcccgggaagaacccgaagaacuuccagaccaugcccggcaucuuccagaccacgaccggcgagaucggggccaucgcgcuggacuucaagcccggcaccagcgggagcccgaucaucaaccgggagggcaagguggugggccuguacgggaacggcgucgugaccaagaacgggggcuacguguccgggaucgcccagacgaacgccgagcccgacggccccacccccgagcucgaggaggagauguucaagaagcgcaaccugaccaucauggaccugcacccgggcagcgggaagacccggaaguaccuccccgccaucguccgcgaggccaucaagcggcgccugcggacgcugauccucgcgcccacccgcgugguggccgccgagauggaggaggcccugaagggccugcccauccgguaccagaccaccgccacgaaguccgagcacaccgggcgcgagaucgucgaccucaugugccacgcgaccuucaccaugcggcugcugagcccggugcgcgugcccaacuacaaccucgucaucauggacgaggcccacuucacggaccccgccuccaucgccgcccggggcuacaucagcacccgcguggggaugggcgaggcggccgccaucuucaugaccgccacgccgcccggcacggcggaggccuucccccaguccaacgcccccauccaggacgaggagcgcgacauccccgagcggagcuggaacuccgggaacgaguggaucaccgacuucgugggcaagaccgucugguucgugcccagcaucaaggccgggaacgacaucgccaacugccugcgcaagaacggcaagaaggugauccagcugucccggaagaccuucgacacggaguaccagaagacccgccucaacgacugggacuucgucgugaccaccgacaucagcgagaugggggcgaacuucaaggccgaccgggugaucgacccccgccggugccugaagcccgucauccugacggacggccccgagcgcgugauccucgccggcccgaugcccgugaccgccgccuccgcggcccagcggcgcgggcgggucggccgcaacccccagaaggagaacgaccaguacaucuucaccgggcagccccugaacaacgacgaggaccacgcccacuggaccgaggccaagaugcugcucgacaacaucaacaccccggagggcaucauccccgcccuguucgagcccgagcgggagaaguccgcggccaucgacggggaguaccgccugaagggcgagucccggaagacguucguggagcucaugcgccggggcgaccugcccgucuggcuggcccacaagguggccagcgaggggaucaaguacaccgaccgcaaguggugcuucgacggcgagcggaacaaccagauccucgaggagaacauggacguggagaucuggaccaaggagggggagcgcaagaagcugcgcccgcgguggcuggacgcgcgcaccuacuccgacccccucgcccugaaggaguucaaggacuucgccgccggccgcaagagcaucgcccuggaccucgucacggagaucggccgcgugcccucccaccuggcgcaccggacccgcaacgcccuggacaaccucgugaugcugcacaccagcgagcacgggggccgggccuaccgccacgccgucgaggagcugccggagaccauggagacgcuccugcugcucgggcugaugauccugcucaccggcggggccaugcuguuccugaucagcggcaagggcaucgggaagaccuccaucggccucaucugcgugaucgugagcuccgggaugcuguggauggcggacgucccccugcaguggaucgccagcgccaucgugcucgaguucuucaugauggugcugcugauccccgagcccgagaagcagcggaccccgcaggacaaccagcucgccuacgucgugaucggcauccugacgcuggccgcgaucguggccgccaacgagauggggcuccuggagaccaccaagcgcgaccugggcauguccaaggagcccggcgucgugagccccaccuccuaccucgacguggaccugcaccccgccagcgccuggacgcuguacgcggucgccaccaccgugaucaccccgaugcuccggcacacgaucgagaacuccaccgccaacgugagccuggccgcgaucgccaaccaggccgucgugcugauggggcucgacaagggcuggcccaucuccaagauggaccugggggugccccugcucgcccugggcugcuacagccaggucaacccccugacccucaccgccgcggugcugcugcucgugacgcacuacgccaucaucgggccgggccugcaggccaaggccacccgcgaggcccagaagcggaccgcggccggcaucaugaagaaccccaccgucgacgggaucaugacgaucgaccuggaccccgugaucuacgacuccaaguucgagaagcagcucggccaggugaugcugcugguccucugcgccgugcagcugcugcucaugcgcaccagcugggcccugugcgaggcccugacccucgcgaccgggcccaucacgacccugugggagggcuccccgggcaaguucuggaacaccaccaucgccgugagcauggccaacaucuuccggggguccuaccuggccggcgcggggcucgccuucagcaucaugaaguccgucggcacggggcgccggggcaccggcagccagggggagacccugggcgagaaguggaagaagaagcugaaccagcucagccgcaaggaguucgaccuguacaagaaguccgggaucaccgagguggaccggaccgaggccaaggagggccugaagcgcggggagacgacccaccacgccgugagccggggcuccgccaagcuccagugguucgucgagcgcaacauggugauccccgagggccgcgugaucgaccuggggugcggccgcgggggcuggagcuacuacugcgcggggcugaagaaggucaccgaggugcgcggcuacaccaagggcgggcccggccacgaggagcccgugccgauguccacguacggguggaacaucgucaagcucaugagcggcaaggacguguucuaccugccgcccgagaagugcgacacccugcugugcgacaucggggaguccagccccuccccgaccguggaggagagccggaccauccgcguccucaagaugguggagcccuggcugcggaacaaccaguucugcaucaaggugcugaaccccuacaugcccacggucaucgagcaccucgagcgccugcagcggaaguacggcggcaugcuggugcgcaacccgcucucccggaacagcacccacgagauguacuggaucuccaacgggaccggcaacaucgugagcuccgucaacauggugagccgccugcugcucaaccgguucaccaugacgcaccgccggcccaccaucgagaaggacgucgaccugggggccggcacccgccacgugaacgccgagcccgagaccccgaacauggacgugaucggcgagcggaucaagcgcaucaaggaggagcacuccagcacguggcacuacgacgacgagaaccccuacaagaccugggccuaccacggguccuacgaggucaaggccaccggcagcgcgagcuccaugaucaacgggguggugaagcugcucaccaagcccugggacgucgugcccauggugacgcagauggccaugaccgacaccaccccguucggccagcagcgggucuucaaggagaagguggacacgcgcacgccccggcccaugcccgggacccgcaaggugauggagaucaccgccgaguggcuguggcgcacgcugggccggaacaagaagccgcgccucugcacccgggaggaguucaccaagaagguccgcaccaacgccgccaugggcgcgguguucacggaggagaaccagugggacagcgcccgggccgccguggaggacgaggaguucuggaagcuggucgaccgcgagcgggagcugcacaagcucgggaagugcggcuccugcguguacaacaugauggggaagcgcgagaagaagcugggcgaguucgggaaggcgaagggcagccgggccaucugguacauguggcugggcgcccgcuaccucgaguucgaggcccugggguuccugaacgaggaccacugguucucccgggagaacagcuacuccggcguggagggggagggccuccacaagcugggguacauccugcgcgacaucagcaagauccccggcggcgccauguacgcggacgacaccgccgggugggacacccggaucaccgaggacgaccuccacaacgaggagaagaucacgcagcagauggaccccgagcaccgccagcuggccaacgccaucuucaagcugaccuaccagaacaaggucgugaaggugcagcggcccaccccgaagggcaccgucauggacaucaucucccgcaaggaccagcgggggagcggccaggugggcaccuacgggcucaacacguucaccaacauggaggcccagcuggugcgccagauggagggcgaggggguccuguccaaggcggaccucgagaacccccaccuccuggagaagaagaucacccaguggcucgagaccaagggcguggagcggcugaagcgcauggccaucagcggggacgacugcguggucaagcccaucgacgaccgguucgccaacgcccugcucgcccugaacgacaugggcaaggugcgcaaggacaucccccaguggcagccguccaagggcuggcacgacuggcagcagguccccuucugcagccaccacuuccacgagcugaucaugaaggacgggcgcaagcucgucgugcccugccggccccaggacgagcugaucggccgcgcgcggaucucccagggggccggcuggagccugaaggagacggccugccucgggaaggccuacgcccagauguggucccugauguacuuccaccgccgggaccugcgccucgcgagcaacgccaucugcuccgccgugccgguccacuggauccccaccagccggaccaccuggagcauccacgcccaccaccaguggaugacgaccgaggacaugcugaccguguggaaccgcguguggaucgaggacaaccccuggauggaggacaagacccccgucacgaccugggaggacgugccguaccugggcaagcgggaggaccaguggugcggcucccucaucgggcugaccagccgcgcgaccugggcccagaacauccugacggccauccagcagguccggucccucaucggcgacgaggaguuccuggacuacaugcccagcaugaagcgcuuccggaaggaggaggaguccgagggggccaucugguga

SEQ ID NO: 9979 - RNA, 9873 nt, Artificial Sequence
  derived and/or modified CDS sequence (opt1) from DENV-3__JF295012__SS-prME
accagccugugccucaugaugaugcugcccgccacccuggccuuccaccucaccagccgcgacggggagccccggaugaucguggggaagaacgagcgcggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaacaagaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccgccucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccggcugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccgcggcgcccggcgcauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcuccgggaucuucgucaccaacgaggugcacacguggaccgagcaguacaaguuccaggccgacagccccaagcggcuggcgaccgccaucgccggcgccugggagaacggggugugcggcauccgcuccaccacgcgcauggagaaccuccuguggaagcagaucgccaacgagcugaacuacauccucugggagaacaacaucaagcugaccgucguggugggggacaucaucggcguccuggagcagggcaagcggacccucacgccccagccgauggagcugaaguacagcuggaagacgugggggaaggcgaagaucgugaccgccgagacccagaacuccagcuucaucaucgacggccccaacacccccgagugccccuccgccagccgcgccuggaacgugugggaggucgaggacuacggguucggcguguucacgaccaacaucuggcugaagcuccgggagguguacacccagagcugcgaccaccgccugauguccgcggccaucaaggacgagcgggccguccacgccgacaugggcuacuggaucgagagccagaagaacggguccuggaagcuggagaaggccagcuucaucgaggugaagaccugcaccuggccgaagucccacacgcucuggagcaacggcgugcuggaguccgacaugaucauccccaagagccuggcggggcccaucucccagcacaaccaccgcccgggcuaccacacccagaccgccgggcccuggcaccucggcaagcuggagcuggacuucaacuacugcgagggcaccacggucgugaucaccgagaacugcgggacccggggccccagccuccgcaccacgaccguguccgggaagcugauccacgaguggugcugccggagcugcacccugcccccgcuccgcuacaugggcgaggacgggugcugguacggcauggagauccggcccaucaacgagaaggaggagaacauggucaagucccuggugagcgccggcuccgggaagguggacaacuucaccaugggcguccugugccucgccauccuguucgaggaggugaugcgcgggaaguucggcaagaagcacaugaucgccggggugcuguucacguucguccuccugcugagcggccagaucaccuggcgggacauggcgcacacccucaucaugaucggcuccaacgccagcgaccgcauggggaugggcgugaccuaccuggcccugaucgccacguucaagauccagcccuuccucgcccugggguucuuccugcggaagcucaccagccgcgagaaccugcugcucggcgugggccuggcgauggccaccacccugcagcuccccgaggacaucgagcagauggccaacgggaucgcccugggccugaugacgcucaagcugaucacccaguucgagaccuaccagcuguggaccgcgcucgucucccugacgugcagcaacaccaucuucacccugaccguggccuggcggacggccacccucauccuggccggggucucccugcucccgcugugccagagcuccagcaugcgcaagaccgacuggcugcccaugaccguggccgcgaugggcgugccgccccugccgcuguucaucuucucccugaaggacacgcccaagcggcgcagcuggccccucaacgagggggucauggccgugggccugguguccauccuggccagcucccuccugcgcaacgacguccccauggccggcccgcugguggccgggggccuccugaucgcgugcuacgugaucaccgggaccagcgccgaccugaccgucgagaaggccgccgacgugacgugggaggaggaggccgagcagaccggcgugucccacaaccucaugaucaccgucgacgacgacgggaccaugcggaucaaggacgacgagaccgagaacauccugacggugcugcucaagaccgcgcugcugaucgugagcggcaucuuccccuacuccauccccgccacccuccuggucuggcacaccuggcagaagcagacgcagcgcagcggcgugcugugggacgugcccuccccgcccgagacccagaaggccgagcucgaggagggggucuaccggaucaagcagcagggcaucuucgggaagacccaggugggcguggggguccagaaggagggcguguuccacaccauguggcacgugacgcgcggcgccguccugacccacaacgggaagcggcuggagcccaacugggccagcgugaagaaggaccucaucuccuacggcgggggcuggcgccugagcgcgcaguggcagaagggggaggaggugcaggucaucgccguggagcccggcaagaacccgaagaacuuccagaccaugcccggcaucuuccagaccacgaccggggagaucggcgccaucgcccuggacuucaagcccgggaccagcggcuccccgaucaucaaccgggagggcaagguggucgggcuguacggcaacgggguggugaccaagaacggcggguacgucagcggcaucgcgcagacgaacgccgagcccgacggccccacccccgagcucgaggaggagauguucaagaagcgcaaccugaccaucauggaccugcacccgggguccggcaagacccggaaguaccuccccgccaucgugcgcgaggccaucaagcggcgccugcggacgcugauccucgcccccacccgcguggucgcggccgagauggaggaggcccugaaggggcugcccauccgguaccagaccaccgccaccaagagcgagcacaccggccgcgagaucguggaccucaugugccacgccaccuucaccaugcggcugcuguccccggugcgcguccccaacuacaaccucgugaucauggacgaggcgcacuucacggaccccgccagcaucgccgcccggggguacaucuccacccgcgugggcaugggcgaggccgcggccaucuucaugaccgccacgccgcccgggacggccgacgcguucccccagagcaacgcccccauccaggacgaggagcgggacauccccgagcgcuccuggaacagcggcaacgaguggaucaccgacuucgccgggaagaccgucugguucgugcccuccaucaaggccggcaacgacaucgccaacugccugcgcaagaacgggaagaaggugauccagcugagccggaagaccuucgacacggaguaccagaagaccaagcucaacgacugggacuucgucgugaccaccgacaucuccgagaugggcgcgaacuucaaggccgaccgcgugaucgacccccggcgcugccugaagcccgucauccugacggacggccccgagcgggugauccucgccgggccgaugcccgugaccgccgccagcgcggcccagcgccggggccgcgucgggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagagccgcaagacguucguggagcucaugcggcgcggggaccugcccgucuggcuggcccacaagguggccuccgagggcaucaaguacaccgaccggaaguggugcuucgacggggagcgcaacaaccagauccucgaggagaacauggacguggagaucuggaccaaggagggcgagcggaagaagcugcgcccgcgguggcuggacgcgcgcaccuacagcgacccccucgcccugaaggaguucaaggacuucgccgccggccgcaaguccaucgcccuggaccucgucacggagaucgggcgggugcccagccaccuggcgcaccgcacccggaacgcccuggacaaccucgugaugcugcacaccagcgagcacggcgggcgcgccuaccggcacgccgucgaggagcugccggagaccauggagacgcuccugcugcucggccugaugauccugcucaccgggggcgccaugcuguuccugaucuccggcaaggggaucggcaagaccagcaucgggcucaucugcgugaucguguccagcggcaugcuguggauggcggacgucccccugcaguggaucgccuccgccaucgugcucgaguucuucaugauggugcugcugauccccgagcccgagaagcagcgcaccccgcaggacaaccagcucgccuacgucgugaucgggauccugacgcuggccgcgaucguggccgccaacgagaugggccuccuggagaccaccaagcgggaccugggcaugagcaaggagcccggggucgugucccccaccagcuaccucgacguggaccugcaccccgccuccgccuggacgcuguacgcggucgccaccaccgugaucaccccgaugcuccgccacacgaucgagaacagcaccgccaacgugucccuggccgcgaucgccaaccaggccgucgugcugaugggccucgacaagggguggcccaucagcaagauggaccugggcgugccccugcucgcccuggggugcuacucccaggucaacccccugacccucaccgccgcggugcugcugcucgugacgcacuacgccaucaucggcccgggccugcaggccaaggccacccgggaggcccagaagcgcaccgcggccgggaucaugaagaaccccaccgucgacggcaucaugacgaucgaccuggaccccgugaucuacgacagcaaguucgagaagcagcucggccaggugaugcugcugguccucugcgccgugcagcugcugcucaugcggaccuccugggcccugugcgaggcccugacccucgcgaccggccccaucacgacccugugggagggcagcccggggaaguucuggaacaccaccaucgccguguccauggccaacaucuuccgcggcagcuaccuggccggggcgggccucgccuucuccaucaugaaguccgucgggacgggccggcgcggcaccgggagccagggcgagacccugggggagaaguggaagaagaagcugaaccagcucucccggaaggaguucgaccuguacaagaaguccggcaucaccgagguggaccgcaccgaggccaaggaggggcugaagcggggcgagacgacccaccacgccgugucccgcggcagcgccaagcuccagugguucgucgagcggaacauggugauccccgaggggcgcgugaucgaccugggcugcgggcggggcgggugguccuacuacugcgcgggccugaagaaggucaccgaggugcgcggcuacaccaagggcgggcccgggcacgaggagcccgugccgaugagcacguacggcuggaacaucgucaagcucauguccgggaaggacguguucuaccugccgcccgagaagugcgacacccugcugugcgacaucggcgagagcucccccagcccgaccguggaggagucccgcaccauccggguccucaagaugguggagcccuggcugcgcaacaaccaguucugcaucaaggugcugaaccccuacaugcccacggucaucgagcaccucgagcggcugcagcgcaaguacggcgggaugcuggugcggaacccgcucagccgcaacuccacccacgagauguacuggaucagcaacggcaccgggaacaucguguccagcgucaacauggugucccggcugcugcucaaccgcuucaccaugacgcaccggcgccccaccaucgagaaggacgucgaccugggcgccggcacccggcacgugaacgccgagcccgagaccccgaacauggacgugaucggggagcgcaucaagcggaucaaggaggagcacagcuccacguggcacuacgacgacgagaaccccuacaagaccugggccuaccacggcagcuacgaggucaaggccaccgggagcgcguccagcaugaucaacggcguggugaagcugcucaccaagcccugggacgucgugcccauggugacgcagauggccaugaccgacaccaccccguucgggcagcagcgcgucuucaaggagaagguggacacgcggacgccccggcccaugcccggcacccggaaggugauggagaucaccgccgaguggcuguggcgcacgcugggccggaacaagaagccgcgccucugcacccgcgaggaguucaccaagaagguccggaccaacgccgccaugggggcgguguucacggaggagaaccagugggacuccgcccgcgccgccguggaggacgaggaguucuggaagcuggucgaccgggagcgcgagcugcacaagcucggcaagugcgggagcugcguguacaacaugaugggcaagcgggagaagaagcugggggaguucggcaaggcgaagggcucccgcgccaucugguacauguggcugggggcccgguaccucgaguucgaggcccugggcuuccugaacgaggaccacugguucagccgcgagaacuccuacagcgggguggagggcgaggggcuccacaagcugggcuacauccugcgggacaucuccaagauccccggcggggccauguacgcggacgacaccgccggcugggacacccgcaucaccgaggacgaccuccacaacgaggagaagaucacgcagcagauggaccccgagcaccggcagcuggccaacgccaucuucaagcugaccuaccagaacaaggucgugaaggugcagcgccccaccccgaaggggaccgucauggacaucaucagccggaaggaccagcgcggcuccggccagguggggaccuacggccucaacacguucaccaacauggaggcccagcuggugcggcagauggagggggagggcguccugagcaaggcggaccucgagaacccccaccuccuggagaagaagaucacccaguggcucgagaccaaggggguggagcgccugaagcggauggccaucuccggcgacgacugcguggucaagcccaucgacgaccgcuucgccaacgcccugcucgcccugaacgacaugggcaaggugcggaaggacaucccccaguggcagccgagcaagggguggcacgacuggcagcagguccccuucugcucccaccacuuccacgagcugaucaugaaggacggccgcaagcucgucgugcccugccggccccaggacgagcugaucgggcgcgcgcgcaucagccagggcgccggguggucccugaaggagacggccugccucggcaaggccuacgcccagauguggagccugauguacuuccaccggcgcgaccugcggcucgcguccaacgccaucugcagcgccgugccgguccacuggauccccaccagccgcaccaccugguccauccacgcccaccaccaguggaugacgaccgaggacaugcugaccguguggaaccggguguggaucgaggacaaccccuggauggaggacaagacccccgucacgaccugggaggacgugccguaccugggcaagcgcgaggaccaguggugcgggagccucaucggccugaccucccgggcgaccugggcccagaacauccugacggccauccagcagguccgcagccucaucggggacgaggaguuccuggacuacaugcccuccaugaagcgguuccgcaaggaggaggagagcgagggcgccaucugguga

SEQ ID NO: 9980 - RNA, 9873 nt, Artificial Sequence
  derived and/or modified CDS sequence (opt1) from DENV-3__FJ898463__SS-prME
accagccucugccucaugaugauccugcccgccgcccuggcguuccaccucaccagccgggacggggagccgcggaugaucguggggaagaacgagcgcggcaagagccugcuguucaagaccgccagcgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcacggagggcgccuggcgccagguggagaagguggagaccugggcccugcgccacccgggguucaccauccucgcccuguuccuggcgcacuacaucggcaccucccucacgcagaagguggugaucuucauccugcugaugcucgugacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacaucaccacggacagccgcugccccacccagggcgaggcggugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggccauccugcccgaguacggcacccuggggcucgagugcuccccgcgcacgggccuggacuucaacgagaugauccugcucaccaugaagaacaaggcguggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgccaugcacacggcgcucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgccccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgccucccgggcguggaacgucugggagguggaggacuacggguucggcguguucaccaccaacaucuggcucaagcugcgcgaggucuacacccagcugugcgaccaccggcucaugagcgccgccgugaaggacgagcgcgccgugcacgccgacaugggcuacuggaucgagagccagaagaacggguccuggaagcuggagaaggcgagccugaucgaggucaagacgugcaccuggccgaagucccacacccucuggagcaacggcgugcuggaguccgacaugaucauccccaagagccuggccgggcccaucucccagcacaaccaccggccgggcuaccacacccagacggccgggcccuggcaccucggcaagcuggagcuggacuucaacuacugcgagggcaccaccguggucaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccuggucuccgccggcagcgggaagguggacaacuucaccaugggcgugcugugccucgccauccuguucgaggaggucaugcgggggaaguucggcaagaagcacaugaucgcggggguguucuucaccuucgugcugcuccuguccggccagaucaccuggcgcgacauggcccacacgcugaucaugaucggcagcaacgccuccgaccggauggggaugggcgucaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccauguucacccugacgguggccuggcgcaccgccacccugauccucgcgggggucagccugcugccggugugccaguccagcuccaugcggaagaccgacuggcuccccauggccgucgccgccaugggcgugccgccccucccgcuguucaucuucagccucaaggacacgcugaagcgccgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugaccguggagaaggcggccgacaucacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcguguucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagacgaccaccggggagaucggcgccaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggcgaucguccgggaggccaucaagcgccggcuccgcacccugauccuggcccccacccgggugguggccgccgagauggaggaggcgcucaaggggcugcccauccgcuaccagaccacggccaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgcggcccgcggguacaucagcacccgggucggcaugggcgaggccgccgcgaucuucaugaccgccacgccgcccgggaccgccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggcggggcccaugccggucaccgccgccuccgccgcccagcggcgcggccggguggggcgcaacagccagaaggagaacgaccaguacaucuucaccggccagccccucaacaacgacgaggaccacgcgcacuggaccgaggccaagaugcugcuggacaacaucaacacgcccgaggggaucauccccgcccucuucgagccggagcgggagaaguccgccgcgaucgacggcgaguaccgccugaagggcgagagccggaagaccuucguggagcugaugcgccgcggggaccuccccgucuggcuggcccacaagguggccuccgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacagcgacccccuggcccucaaggaguucaaggacuucgcggccggccgcaaguccaucgcccuggaccuggugaccgagaucgggcgggugccgagccaccucgcccaccgcacccggaacgcccuggacaaccuggucaugcuccacaccagcgagcacggcgggcgcgcguaccggcacgccguggaggagcugcccgagacgauggagacccugcuccugcugggccucaugauccugcugaccgggggcgccaugcuguuccugaucuccggcaaggggaucggcaagaccagcaucgggcugaucugcgugaucgccuccagcggcaugcucuggauggccgagaucccccugcaguggaucgcguccgccaucguccuggaguucuucaugauggugcuccugaucccggagcccgagaagcagcgcacgccccaggacaaccagcuggccuacguggucaucgggauccucacccuggccgccaucaucgcggccaacgagaugggccugcucgagaccaccaagcgggaccugggcaugagcaaggagcccggggugguguccccgacgagcuaccuggacgucgaccuccaccccgccuccgccuggacccuguacgcgguggccaccaccgugaucacgcccaugcugcgccacaccaucgagaacagcaccgccaacgucucccucgccgccaucgcgaaccaggccguggugcugaugggccuggacaagggguggcccaucagcaagauggaccucggcgucccgcugcuggcccucgggugcuacucccaggugaacccccugacccugacggccgccgugcuccugcugaucacccacuacgcgaucaucggccccggccuccaggccaaggccacccgggaggcccagaagcgcaccgccgcggggaucaugaagaaccccacggucgacggcaucaugaccaucgaccuggacccggugaucuacgacagcaaguucgagaagcagcugggccaggugaugcuccugguccugugcgccgugcagcuccugcugaugcggaccuccugggcccucugcgaggcccugacccuggcgacgggccccaucaccacccucugggagggcagccccgggaaguucuggaacaccacgaucgccguguccauggccaacaucuuccgcggcagcuaccuggccggggccggccuggcguucuccaucaugaaguccgucgggaccggcaagcggggcaccgggagccagggcgagacccucggggagaaguggaagaagaagcugaaccagcugucccgcaaggaguucgaccucuacaagaaguccggcaucaccgagguggaccggacggaggccaaggaggggcugaagcgcggcgagaccacccaccacgccgugucccggggcagcgccaagcugcagugguucgucgagcgcaacauggugauccccgaggggcgggugaucgaccucggcugcgggcgcggcgggugguccuacuacugcgccggccugaagaaggucaccgaggugcggggcuacacgaagggcgggccggggcacgaggagcccgugcccaugagcaccuacggcuggaacaucgucaagcugauguccgggaaggacguguucuaccucccgcccgagaagugcgacacccugcugugcgacaucggcgagagcucccccagccccaccguggaggagucccgcacgauccgcguccugaagaugguggagcccuggcucaagaacaaccaguucugcaucaaggugcugaaccccuacaugcccaccgucaucgagcaccuggagcggcuccagcgcaagcacggcgggaugcuggugcggaacccccugagccgcaacuccacccacgagauguacuggaucagcaacggcaccgggaacaucguggcguccgucaacauggugagccggcuccugcugaaccgcuucacgaugacccaccggcgccccaccaucgagaaggacguggaccucggcgccggcacccggcacgucaacgccgagccggagacgcccaacauggacgugaucggggagcgcaucaagcggaucaaggaggagcacaacuccaccuggcacuacgacgacgagaaccccuacaagaccugggccuaccacggcagcuacgaggugaaggccaccggguccgcgagcagcaugaucaacggcgucgugaagcugcugacgaagccgugggacgucgugcccauggugacccagauggccaugaccgacaccacgcccuucgggcagcagcgcgucuucaaggagaagguggacacccggacgccccgguccaugccgggcacccggcgcgugaugggcaucacggccgaguggcucuggaccacccuggggcggaacaagaagccccgccugugcacccgggaggaguucacgaagaagguccgcaccaacgccgcgaugggcgccguguucaccgaggagaaccagugggacagcgccaaggccgccguggaggacgaggacuucuggaagcucgucgaccgcgagcgggagcugcacaagcuggggaagugcggcuccugcguguacaacaugauggggaagcgcgagaagaagcucggcgaguucggcaaggcgaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgcggacgacaccgccgggugggacacgcggaucaccgaggacgaccugcacaacgaggagaagaucacccagcagauggaccccgagcaccgccagcucgccaacgccaucuucaagcugaccuaccagaacaaggucgugaaggugcagcggccgacccccacgggcaccgucauggacaucaucucccgcaaggaccagcggggcagcggccaggugggcaccuacgggcugaacaccuucacgaacauggaggcccagcucauccgccagauggagggcgagggggugcuguccaaggcggaccuggagaacccccaccuccccgagaagaagaucacccaguggcuggagaccaagggcgucgagcggcugaagcgcauggccaucagcggcgacgacugcguggugaagccgaucgacgaccgguucgccaacgcccuccuggcccugaacgacauggggaagguccgcaaggacaucccccaguggcagcccuccaagggcuggcacgacuggcagcagguccccuucugcagccaccacuuccacgagcucaucaugaaggacgggcggaagcugguggucccgugccgcccccaggacgagcugaucggccgggcgcgcaucucccagggggccggcuggagccuccgggagaccgccugccugggcaaggccuacgcgcagauguggucccugauguacuuccaccgccgcgaccuccggcuggccagcaacgccaucugcuccgccgugcccgugcacuggguccccacgagccgcaccaccuggagcauccacgcccaccaccaguggaugaccacggaggacaugcugaccguguggaaccggguguggaucgaggacaacccguggauggaggacaagacccccgucaccacgugggagaacgugcccuaccucgggaagcgcgaggaccaguggugcggcucccugaucgggcugaccagccgggcgaccugggcccagaacauccccaccgccauccagcagguccgcucccucaucggcaacgaggaguuccuggacuacaugccgagcaugaagcgguuccgcaaggaggaggaguccgagggggccaucugguga

SEQ ID NO: 9981 - RNA, 9873 nt, Artificial Sequence
  derived and/or modified CDS sequence (opt1) from DENV-3__GQ868616__SS-prME
accagccucugccucaugaugauccugcccgccgcccuggcguuccaccucaccagccgggacggggagccgcggaugaucguggggaagaacgagcgcggcaagagccugcuguucaagaccgccagcgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcacggagggcgccuggcgccagguggagaagguggagaccugggcccugcgccacccgggguucaccauccucgcccuguuccuggcgcacuacaucggcaccucccucacgcagaagguggugaucuucauccugcugaugcucgugacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacaucaccacggacagccgcugccccacccagggcgaggcggugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggccauccugcccgaguacggcacccuggggcucgagugcuccccgcgcacgggccuggacuucaacgagaugauccugcucaccaugaagaacaaggcguggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgccaugcacacggcgcucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgccccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgccucccgggcguggaacgucugggagguggaggacuacggguucggcguguucaccaccaacaucuggcucaagcugcgcgaggucuacacccagcugugcgaccaccggcucaugagcgccgccgugaaggacgagcgcgccgugcacgccgacaugggcuacuggaucgagagccagaagaacggguccuggaagcuggagaaggcgagccugaucgaggucaagacgugcaccuggccgaagucccacacccucuggagcaacggcgugcuggaguccgacaugaucauccccaagagccuggccgggcccaucucccagcacaaccaccggccgggcuaccacacccagacggccgggcccuggcaccucggcaagcuggagcuggacuucaacuacugcgagggcaccaccguggucaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccuggucuccgccggcagcgggaagguggacaacuucaccaugggcgugcugugccucgccauccuguucgaggaggucaugcgggggaaguucggcaagaagcacaugaucgcggggguguucuucaccuucgugcugcuccuguccggccagaucaccuggcgcgacauggcccacacgcugaucaugaucggcagcaacgccuccgaccggauggggaugggcgucaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccauguucacccugacgguggccuggcgcaccgccacccugauccucgcgggggucagccugcugccggugugccaguccagcuccaugcggaagaccgacuggcuccccauggccgucgccgccaugggcgugccgccccucccgcuguucaucuucagccucaaggacacgcugaagcgccgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugaccguggagaaggcggccgacaucacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcguguucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagacgaccaccggggagaucggcgccaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggcgaucguccgggaggccaucaagcgccggcuccgcacccugauccuggcccccacccgggugguggccgccgagauggaggaggcgcucaaggggcugcccauccgcuaccagaccacggccaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgcggcccgcggguacaucagcacccgggucggcaugggcgaggccgccgcgaucuucaugaccgccacgccgcccgggaccgccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggcggggcccaugccggucaccgccgccuccgccgcccagcggcgcggccggguggggcgcaacagccagaaggagaacgaccaguacaucuucaccggccagccccucaacaacgacgaggaccacgcgcacuggaccgaggccaagaugcugcuggacaacaucaacacgcccgaggggaucauccccgcccucuucgagccggagcgggagaaguccgccgcgaucgacggcgaguaccgccugaagggcgagagccggaagaccuucguggagcugaugcgccgcggggaccuccccgucuggcuggcccacaagguggccuccgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacagcgacccccuggcccucaaggaguucaaggacuucgcggccggccgcaaguccaucgcccuggaccuggugaccgagaucgggcgggugccgagccaccucgcccaccgcacccggaacgcccuggacaaccuggucaugcuccacaccagcgagcacggcgggcgcgcguaccggcacgccguggaggagcugcccgagacgauggagacccugcuccugcugggccucaugauccugcugaccgggggcgccaugcuguuccugaucuccggcaaggggaucggcaagaccagcaucgggcugaucugcgugaucgccuccagcggcaugcucuggauggccgagaucccccugcaguggaucgcguccgccaucguccuggaguucuucaugauggugcuccugaucccggagcccgagaagcagcgcacgccccaggacaaccagcuggccuacguggucaucgggauccucacccuggccgccaucaucgcggccaacgagaugggccugcucgagaccaccaagcgggaccugggcaugagcaaggagcccggggugguguccccgacgagcuaccuggacgucgaccuccaccccgccuccgccuggacccuguacgcgguggccaccaccgugaucacgcccaugcugcgccacaccaucgagaacagcaccgccaacgucucccucgccgccaucgcgaaccaggccguggugcugaugggccuggacaagggguggcccaucagcaagauggaccucggcgucccgcugcuggcccucgggugcuacucccaggugaacccccugacccugacggccgccgugcuccugcugaucacccacuacgcgaucaucggccccggccuccaggccaaggccacccgggaggcccagaagcgcaccgccgcggggaucaugaagaaccccacggucgacggcaucaugaccaucgcccuggacccggugaucuacgacagcaaguucgagaagcagcugggccaggugaugcuccugguccugugcgccgugcagcuccugcugaugcggaccuccugggcccucugcgaggcgcugacccuggccacgggccccaucaccacccucugggagggcagccccgggaaguucuggaacaccacgaucgccguguccauggccaacaucuuccgcggcagcuaccuggccggggcgggccuggccuucuccaucaugaaguccgucgggaccggcaagcggggcaccgggagccagggcgagacccucggggagaaguggaagaagaagcugaaccagcugucccgcaaggaguucgaccucuacaagaaguccggcaucaccgagguggaccggacggaggccaaggaggggcugaagcgcggcgagaccacccaccacgccgugucccggggcagcgccaagcugcagugguucgucgagcgcaacauggugauccccgaggggcgggugaucgaccucggcugcgggcgcggcgggugguccuacuacugcgcgggccugaagaaggucaccgaggugcggggcuacacgaagggcgggccggggcacgaggagcccgugcccaugagcaccuacggcuggaacaucgucaagcugauguccgggaaggacguguucuaccucccgcccgagaagugcgacacccugcugugcgacaucggcgagagcucccccagccccaccguggaggagucccgcacgauccgcguccugaagaugguggagcccuggcucaagaacaaccaguucugcaucaaggugcugaaccccuacaugcccaccgucaucgagcaccuggagcggcuccagcgcaagcacggcgggaugcuggugcggaacccccugagccgcaacuccacccacgagauguacuggaucagcaacggcaccgggaacaucguggccuccgucaacauggugagccggcuccugcugaaccgcuucacgaugacccaccggcgccccaccaucgagaaggacguggaccucggcgccggcacccggcacgucaacgccgagccggagacgcccaacauggacgugaucggggagcgcaucaagcggaucaaggaggagcacaacuccaccuggcacuacgacgacgagaaccccuacaagaccugggccuaccacggcagcuacgaggugaaggcgaccggguccgccagcagcaugaucaacggcgucgugaagcugcugacgaagccgugggacgucgugcccauggugacccagauggccaugaccgacaccacgcccuucgggcagcagcgcgucuucaaggagaagguggacacccggacgccccgguccaugccgggcacccggcgcgugaugggcaucacgcccgaguggcucuggcggccccuggggcgcaacaagaagccccggcugugcccgcgcgaggaguucaccaagaagguccgcaccaacgcccccaugggcgcgguguucaccgaggagacgcagugggccagcgccaaggccgccguggaggacgaggacuucuggaagcucgucgaccgggagcgcgagcugcacaagcuggggaagugcggcuccugcguguacaacaugauggggaagcgggagaagaagcucggcgaguucggcaaggcgaaggggagccgcgccaucugguacauguggcugggcgcccgguaccuggaguucgaggcccucggguuccugaacgaggaccacugguucucccgcgagaacagcuacuccggcguggagggggagggccugcccaagcucggcuacauccugcgggacaucagcaagauccccgggggcgccauguacgcggacgacaccgccgggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucucccggaaggaccagcgcggcagcggccaggugggcacguacgggcugaacaccuucaccaacauggaggcccagcucauccggcagauggagggcgagggggugcuguccaaggcggaccuggagaacccccaccucccggagaagaagaucacccaguggcuggagacgaagggcgucgagcgccugaagcggauggccaucagcggcgacgacugcguggugaagcccaucgacgaccgcuucgccaacgcccuccuggcccugaacgacauggggaagguccggaaggacaucccccaguggcagcccuccaagggcuggcacgacuggcagcaggucccguucugcagccaccacuuccacgagcucaucaugaaggacgggcgcaagcuggugguccccugccggccccaggacgagcugaucggccgcgcgcggaucucccagggggccggcuggagccuccgcgagaccgccugccugggcaaggccuacgcgcagauguggucccugauguacuuccaccgccgggaccuccgccuggccagcaacgccaucugcuccgccgugcccgugcacugggucccgaccagccggaccacguggagcauccacgcccaccaccaguggaugaccaccgaggacaugcugaccguguggaaccgcguguggaucgaggacaaccccuggauggaggacaagacgcccgucaccaccugggagaacgugccguaccucgggaagcgggaggaccaguggugcggcucccugaucgggcugaccagccgcgcgacgugggcccagaacauccccaccgccauccagcagguccggucccucaucggcaacgaggaguuccuggacuacaugcccagcaugaagcgcuuccggaaggaggaggaguccgagggggccaucugguga

SEQ ID NO: 9982 - RNA, 9873 nt, Artificial Sequence
  derived and/or modified CDS sequence (opt1) from DENV-3__GQ199887__SS-prME
accagccugugccucaugaugauccugcccgccgcccuggcguuccaccucaccucccgcgacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugcccgaggagcaggaccagaacuacgucugcaagcacaccuacguggaccggggguggggcaacgggugcggccucuucgggaagggcucccuggugaccugcgccaaguuccagugccuggagagcaucgagggcaaggucgugcaguacgagaaccucaaguacaccgugaucaucacgguccacaccggggaccagcaccaggugggcaacgagacccagggggucaccgccgagaucacgccccaggccuccaccaccgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaaccgcaaggagcuccuggugaccuucaagaacgcccacgccaagaagcaggaggucguggugcuggggagccaggagggcgcgaugcacaccgcccucacgggggccaccgagauccagaacuccggcgggaccagcaucuucgccggccaccugaagugccggcugaagauggacaagcucgagcugaagggcauguccuacgccaugugcaccaacacguucguccugaagaaggaggugagcgagacccagcacgggaccauccucgugaaggucgaguacaagggcgaggacgcgcccugcaagaucccguucagcaccgaggacgggcagggcaaggcccacaacggccgccugaucacggccaaccccguggugaccaagaaggaggagcccgucaacaucgaggccgagcccccguucggggaguccaacaucgugaucggcaucggggacaacgcgcugaagaucaacugguacaagaagggcagcuccaucgggaagauguucgaggccaccgcccggggcgcccgccggauggccauccugggcgacaccgcgugggacuucgggagcgugggcgggguccucaacucccugggcaagauggugcaccagaucuucgggagcgccuacacggcccuguucuccggcgugagcugggucaugaagaucggcaucggggugcuccugaccuggaucggccugaacuccaagaacaccagcauguccuucagcugcaucgccaucgggaucaucacccucuaccugggcgccgugguccaggcggacauggggugcgugaucaacuggaagggcaaggagcugaagugcggcuccgggaucuucgugacgaacgagguccacaccuggaccgagcaguacaaguuccaggccgacagccccaagcgccucgccaccgccaucgccggcgcgugggagaacggggugugcggcauccgcuccacgacccggauggagaaccugcuguggaagcagaucgccaacgagcucaacuacauccugugggagaacaacaucaagcugaccguggucgugggggacaccaucggcgugcucgagcagggcaagcgcacgcugacgccccagcccauggagcugaaguacagcuggaagaccugggggaaggccaagaucgucaccgccgagauccagaacuccagcuucaucaucgacggcccgaacacgcccgagugccccuccgcgagccgggccuggaacgugugggagguggaggacuacggguucggcgucuucaccaccaacaucuggcucaagcugcgcgagguguacacccagcugugcgaccaccggcucaugagcgccgccgugaaggacgagcgcgccguccacgcggacaugggcuacuggaucgagucccagaagaacgggagcuggaagcuggagaaggccuccuucaucgaggugaagaccugcacguggcccaagagccacacccugugguccaacggcgugcucgagagcgacaugaucaucccgaagucccuggccgggcccaucagccagcacaacuaccggcccggcuaccacacccagaccgccgggccguggcaccugggcaagcucgagcuggacuucaacuacugcgagggcacgaccgucgugaucaccgagaacugcgggacccgcggccccucccugcggacgaccaccgugagcgggaagcucauccacgaguggugcugccgcuccugcacccugccgccccuccgguacaugggcgaggacgggugcugguacggcauggagauccgcccgaucagcgagaaggaggagaacauggucaagucccucgccagcgcgggcuccgggaagguggacaacuucacgaugggcgugcugugccuggccauccucuucgaggaggucaugcgggggaaguucggcaagaagcacaugaucgccgggguguucuucaccuucgugcugcugcucagcggccagaucaccuggcgcgacauggcccacacccugaucaugaucggcuccaacgccagcgaccggauggggaugggcgucacguaccuggcgcucaucgccaccuucaagauccagcccuuccuggcccugggguucuuccuccgcaagcugaccagccgggagaaccugcuccugggcgugggccuggccauggcgaccacgcuccagcugcccgaggacaucgagcagauggccaacgggaucgcccugggccucauggcccugaagcugaucacccaguucgagaccuaccagcucuggaccgcccuggugucccugacgugcagcaacaccauguucacccucaccgucgcguggcgcacggccacccugauccuggccggggugucccuccugcccgucugccagagcuccagcaugcggaagaccgacuggcugccgaugaccguggccgccaugggcgugccgccccucccccuguucaucuucucccugaaggacacgcucaagcgccgcagcuggccgcugaacgagggggucauggcggugggccugguguccauccucgccagcucccugcugcggaacgacguccccauggccggcccccucguggccgggggccugcugaucgccugcuacgugaucaccgggaccagcgcggaccucaccgucgagaaggccgccgacgugacgugggaggaggaggccgagcagaccggcgugucccacaaccugaugaucaccgucgacgacgacgggaccaugcgcaucaaggacgacgagaccgagaacauccugacggugcuccugaagaccgcccugcucaucgugagcggcaucuuccccuacuccaucccggcgacccugcuggucuggcacaccuggcagaagcagacgcagcggagcggcgugcucugggacgugcccagcccgcccgagacccagaaggccgagcuggaggagggggucuaccgcaucaagcagcagggcauccuggggaagacccaggugggcguggggguccagaaggagggcguguuccacaccauguggcacgugacgcggggcgccguccucacccacaacgggaagcgccuggagccgaacugggccagcgugaagaaggaccugaucuccuacggcgggggcuggcggcucagcgcgcaguggcagaagggggaggaggugcaggucaucgccguggagcccggcaagaaccccaagaacuuccagaccaugcccggcaccuuccagacgaccaccggggagaucggcgccaucgcccuggacuucaagccggggaccagcggcucccccaucaucaaccgcgagggcaagguggucgggcuguacggcaacgggguggugacgaagaacggcggguacgucagcggcaucgcccagaccaacgcggagcccgacggcccgacccccgagcuggaggaggagauguuccggaagcgcaaccucaccaucauggaccugcaccccggguccggcaagacgcggaaguaccugcccgccaucgugcgcgaggccaucaagcggcgccuccggacccugauccuggccccgacccgcguggucgccgcggagauggaggaggcccucaaggggcugcccauccgguaccagaccacggccaccaagagcgagcacaccggccgcgagaucguggaccugaugugccacgccaccuucacgaugcggcuccugucccccgugcgcguccccaacuacaaccugaucaucauggacgaggcccacuucaccgacccggcgagcaucgccgcccggggguacaucuccacccgcgugggcaugggcgaggccgcggccaucuucaugaccgccacgccgcccgggaccgccgacgccuucccccagagcaacgcgccgauccaggacgaggagcgcgacauccccgagcgguccuggaacagcggcaacgaguggaucaccgacuucgccgggaagaccgugugguucguccccuccaucaaggccggcaacgacaucgccaacugccuccgcaagaacgggaagaaggugauccagcugagccggaagacguucgacaccgaguaccagaagaccaagcugaacgacugggacuucguggucaccacggacaucuccgagaugggcgccaacuucaaggcggaccgcgugaucgacccccggcgcugccucaagccggugauccugaccgacggccccgagcgggucauccuggccgggcccaugcccgugaccgccgccagcgccgcgcagcgccggggccgcguggggcggaacccgcagaaggagaacgaccaguacaucuucaccggccagccccucaacaacgacgaggaccacgcccacuggaccgaggccaagaugcugcuggacaacaucaacacgcccgaggggaucauccccgcccucuucgagccggagcgcgagaaguccgcggccaucgacggcgaguaccggcugaagggcgagagccgcaagaccuucgucgagcugaugcggcgcggggaccuccccguguggcuggcccacaaggucgccuccgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcacguacagcgacccccuggcgcucaaggaguucaaggacuucgccgccggccggaaguccaucgcccuggaccuggugaccgagaucgggcgcgucccgagccaccucgcccaccggacccgcaacgcgcuggacaaccuggugaugcuccacaccagcgagcacggcgggcgggccuaccgccacgccguggaggagcugcccgagacgauggagacccugcuccugcugggccucaugauccugcugaccgggggcgucaugcuguuccugaucuccggcaaggggaucggcaagaccagcaucgggcugaucugcgugaucgccuccagcggcaugcucuggauggccgacgugccccugcaguggaucgcguccgccaucguccuggaguucuucaugauggugcuccugaucccggagcccgagaagcagcggacgccccaggacaaccagcuggccuacguggucaucgggauccucacccuggccgccaucaucgcggccaacgagaugggccugcucgagaccaccaagcgcgaccugggcaugagcaaggagcccggggugguguccccgacgagcuaccuggacgucgaccuccaccccgccuccgccuggacccuguacgcgguggccaccaccgugaucacgcccaugcugcggcacaccaucgagaacagcaccgccaacgucucccucgccgccaucgcgaaccaggccguggugcugaugggccuggacaagggguggcccaucagcaagauggaccucggcgucccgcugcuggcccucgggugcuacucccaggugaacccccugacccugacggccgccgugcuccugcugaucacccacuacgcgaucaucggccccggccuccaggccaaggccacccgcgaggcccagaagcggaccgccgcggggaucaugaagaaccccacggucgacggcaucaugaccaucgaccuggacccggugaucuacgacagcaaguucgagaagcagcugggccaggugaugcuccugguccugugcgccgugcagcuccugcugaugcgcaccuccugggcccucugcgaggcccugacccuggcgacgggccccaucaccacccucugggagggcagccccgggaaguucuggaacaccacgaucgccguguccauggccaacaucuuccggggcagcuaccuggccggggccggccuggcguucuccaucaugaaguccgucgggaccggcaagcgcggcaccgggagccagggcgagacccucggggagaaguggaagaagaagcugaaccagcugagccggaaggaguucgaccucuacaagaaguccggcaucaccgagguggaccgcacggaggccaaggaggggcugaagcggggcgagaccacccaccacgccgugucccgcggcagcgccaagcugcagugguucgucgagcggaacauggugauccccgaggggcgcgugaucgaccucggcugcgggcggggcgggugguccuacuacugcgccggccugaagaaggucaccgaggugcgcggcuacacgaagggcgggccggggcacgaggagcccgugcccaugagcaccuacggcuggaacaucgucaagcugauguccgggaaggacguguucuaccucccgcccgagaagugcgacacccugcugugcgacaucggcgagagcucccccagccccaccguggaggagucccgcacgauccggguccugaagaugguggagcccuggcucaagaacaaccaguucugcaucaaggugcugaaccccuacaugcccaccgucaucgagcaccuggagcgccuccagcggaagcacggcgggaugcuggugcgcaacccccugagccggaacuccacccacgagauguacuggaucagcaacggcaccgggaacaucguguccagcgucaacauggugucccgccuccugcugaaccgguucacgaugacccaccgccggcccaccaucgagcgcgacguggaccucggcgcgggcacccggcacgucaacgccgagccggagauccccaacauggacgugaucggggagcgcaucaagcggaucaaggaggagcacaacagcacguggcacuacgacgacgagaaccccuacaagaccugggccuaccacggcuccuacgaggucaaggccaccgggagcgccagcuccaugaucaacggcguggugaagcugcugaccaagccgugggacgucgugcccauggugacgcagauggcgaugaccgacaccacccccuucgggcagcagcgcgucuucaaggagaagguggacacgcggacgccccggccgaugcccggcacccggaaggugauggagaucaccgccgaguggcucuggcgcacgcugggccggaacaagcgcccccgccugugcacccgggaggaguucaccaagaagguccgcaccaacgccgccaugggggcgguguucacggaggagaaccagugggacagcgccaaggccgccguggaggacgaggaguucuggaagcucgucgaccgggagcgcgagcugcacaagcugggcaagugcggguccugcguguacaacaugaugggcaagcgggagaagaagcucggggaguucggcaaggccaagggcagccgcgcgaucugguacauguggcugggggcccgguaccuggaguucgaggcccucggcuuccugaacgaggaccacugguucucccgcgagaacagcuacuccgggguggagggcgaggggcugcacaagcucggcuacauccugcgggacaucagcaagauccccggcggggccauguacgccgacgacaccgcgggcugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccgggaccgucauggacaucaucucccggaaggaccagcgcggcagcggccagguggggacguacggccugaacaccuucaccaacauggaggcccagcucgugcggcagauggagggggagggcguccuguccaaggccgaccuggagaacccccaccuccuggagaagaagaucacccaguggcuggagacgaaggggguggagcgccucaagcggauggcgaucagcggcgacgacugcguggucaagccgaucgacgaccgcuucgccaacgcccugcuggcccucaacgacaugggcaaggugcggaaggacaucccccaguggcagcccuccaagggguggcacgacuggcagcagguccccuucugcagccaccacuuccacgagcugaucaugaaggacggccgcaagcuggucgugccgugccggccccaggacgagcucaucgggcgcgcccgcaucucccagggcgcgggguggagccugcgggagaccgccugccugggcaaggccuacgcccagauguggucccucauguacuuccaccgccgggaccugcgccuggcgagcaacgccaucugcuccgccgugcccguccacugggugcccaccagccggaccacguggagcauccacgcccaccaccaguggaugaccaccgaggacaugcucaccguguggaaccgcgucuggaucgaggacaacccguggauggaggacaagacgcccgugaccaccugggagaacgugcccuaccugggcaagcgggaggaccaguggugcgggucccugaucggccucaccagccgcgccacgugggcgcagaacauccccaccgccauccagcagguccggucccugaucgggaacgaggaguuccuggacuacaugccgagcaugaagcgcuuccggaaggaggaggaguccgagggcgccaucugguga

SEQ ID NO: 9983 - RNA, 9873 nt, Artificial Sequence
  derived and/or modified CDS sequence (opt1) from DENV-3__GQ199888__SS-prME
accagccugugccucaugaugauccugcccgccgcccuggcguuccaccucaccucccgcgacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagaccugggcccugcgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugcccgaggagcaggaccagaacuacgucugcaagcacaccuacguggaccggggguggggcaacgggugcggccucuucgggaagggcucccuggugaccugcgccaaguuccagugccuggagagcaucgagggcaaggucgugcaguacgagaaccucaaguacaccgugaucaucacgguccacaccggggaccagcaccaggugggcaacgagacccagggggucaccgccgagaucacgccccaggccuccaccaccgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaaccgcaaggagcuccuggugaccuucaagaacgcccacgccaagaagcaggaggucguggugcuggggagccaggagggcgcgaugcacaccgcccucacgggggccaccgagauccagaacuccggcgggaccagcaucuucgccggccaccugaagugccggcugaagauggacaagcucgagcugaagggcauguccuacgccaugugcaccaacacguucguccugaagaaggaggugagcgagacccagcacgggaccauccucgugaaggucgaguacaagggcgaggacgcgcccugcaagaucccguucagcaccgaggacgggcagggcaaggcccacaacggccgccugaucacggccaaccccguggugaccaagaaggaggagcccgucaacaucgaggccgagcccccguucggggaguccaacaucgugaucggcaccggggacaacgcgcugaagaucaacugguacaagaagggcagcuccaucgggaagauguucgaggccaccgcccggggcgcccgccggauggccauccugggcgacacggcgugggacuucgggagcgugggcgggguccucaacucccugggcaagauggugcaccagaucuucgggagcgccuacaccgcccuguucuccggcgugagcugggucaugaagaucggcaucggggugcuccugaccuggaucggccugaacuccaagaacaccagcauguccuucagcugcaucgccaucgggaucaucacgcucuaccugggcgccgugguccaggcggacauggggugcgugaucaacuggaagggcaaggagcugaagugcggcuccgggaucuucgugaccaacgagguccacaccuggaccgagcaguacaaguuccaggccgacagccccaagcgccucgccacggccaucgccggcgcgugggagaacggggugugcggcauccgcuccaccacccggauggagaaccugcuguggaagcagaucgccaacgagcucaacuacauccugugggagaacaacaucaagcugaccguggucgugggggacacgaucggcgugcucgagcagggcaagcgcacccugacgccccagcccauggagcugaaguacagcuggaagaccugggggaaggccaagaucgucacggccgagauccagaacuccagcuucaucaucgacggcccgaacacccccgagugccccuccgcgagccgggccuggaacgugugggagguggaggacuacggguucggcgucuucaccaccaacaucuggcucaagcugcgcgagguguacacccagcugugcgaccaccggcucaugagcgccgccgugaaggacgagcgcgccguccacgcggacaugggcuacuggaucgagucccagaagaacgggagcuggaagcuggagaaggccuccuucaucgaggugaagacgugcaccuggcccaagagccacacccugugguccaacggcgugcucgagagcgacaugaucaucccgaagucccuggccgggcccaucagccagcacaacuaccggcccggcuaccacacccagacggccgggccguggcaccugggcaagcucgagcuggacuucaacuacugcgagggcaccaccgucgugaucaccgagaacugcgggacgcgcggccccucccugcggaccaccaccgugagcgggaagcucauccacgaguggugcugccgcuccugcacgcugccgccccuccgguacaugggcgaggacgggugcugguacggcauggagauccgcccgaucagcgagaaggaggagaacauggucaagucccucgccagcgcgggcuccgggaagguggacaacuucaccaugggcgugcugugccuggccauccucuucgaggaggucaugcgggggaaguucggcaagaagcacaugaucgccgggguguucuucaccuucgugcugcugcucagcggccagaucaccuggcgcgacauggcccacacgcugaucaugaucggcuccaacgccagcgaccggauggggaugggcgucaccuaccuggcgcucaucgccaccuucaagauccagcccuuccuggcccugggguucuuccuccgcaagcugaccagccgggagaaccugcuccugggcgugggccuggccauggcgacgacccuccagcugcccgaggacaucgagcagauggccaacgggaucgcccugggccucauggcccugaagcugaucacccaguucgagaccuaccagcucuggacggcccuggugucccugaccugcagcaacaccauguucacccucacggucgcguggcgcaccgccacccugauccuggccggggugucccuccugcccgucugccagagcuccagcaugcggaagaccgacuggcugccgaugacgguggccgccaugggcgugccgccccucccccuguucaucuucucccugaaggacacccucaagcgccgcagcuggccgcugaacgagggggucauggcggugggccugguguccauccucgccagcucccugcugcggaacgacguccccauggccggcccccucguggccgggggccugcugaucgccugcuacgugaucaccgggaccagcgcggaccucacggucgagaaggccgccgacgugaccugggaggaggaggccgagcagaccggcgugucccacaaccugaugaucaccgucgacgacgacgggaccaugcgcaucaaggacgacgagacggagaacauccugaccgugcuccugaagaccgcccugcucaucgugagcggcaucuuccccuacuccaucccggcgacccugcuggucuggcacacguggcagaagcagacccagcggagcggcgugcucugggacgugcccagcccgcccgagacccagaaggccgagcuggaggagggggucuaccgcaucaagcagcagggcauccuggggaagacccaggugggcguggggguccagaaggagggcguguuccacacgauguggcacgugacccggggcgccguccucacccacaacgggaagcgccuggagccgaacugggccagcgugaagaaggaccugaucuccuacggcgggggcuggcggcucagcgcgcaguggcagaagggggaggaggugcaggucaucgccguggagcccggcaagaaccccaagaacuuccagaccaugcccggcacguuccagaccaccaccggggagaucggcgccaucgcccuggacuucaagccggggacgagcggcucccccaucaucaaccgcgagggcaagguggucgggcuguacggcaacgggguggugaccaagaacggcggguacgucagcggcaucgcccagaccaacgcggagcccgacggcccgacccccgagcuggaggaggagauguuccggaagcgcaaccucacgaucauggaccugcaccccggguccggcaagacccggaaguaccugcccgccaucgugcgcgaggccaucaagcggcgccuccggacccugauccuggccccgacccgcguggucgccgcggagauggaggaggcccucaaggggcugcccauccgguaccagacgaccgccaccaagagcgagcacaccggccgcgagaucguggaccugaugugccacgccacguucaccaugcggcuccugucccccgugcgcguccccaacuacaaccugaucaucauggacgaggcccacuucaccgacccggcgagcaucgccgcccggggguacaucuccacccgcgugggcaugggcgaggccgcggccaucuucaugacggccacgccgcccgggaccgccgacgccuucccccagagcaacgcgccgauccaggacgaggagcgcgacauccccgagcgguccuggaacagcggcaacgaguggaucaccgacuucgccgggaagacggugugguucguccccuccaucaaggccggcaacgacaucgccaacugccuccgcaagaacgggaagaaggugauccagcugagccggaagaccuucgacaccgaguaccagaagaccaagcugaacgacugggacuucguggucacgaccgacaucuccgagaugggcgccaacuucaaggcggaccgcgugaucgacccccggcgcugccucaagccggugauccugaccgacggccccgagcgggucauccuggccgggcccaugcccgugaccgccgccagcgccgcgcagcgccggggccgcguggggcggaacccgcagaaggagaacgaccaguacaucuucaccggccagccccucaacaacgacgaggaccacgcccacuggacggaggccaagaugcugcuggacaacaucaacacccccgaggggaucauccccgcccucuucgagccggagcgcgagaaguccgcggccaucgacggcgaguaccggcugaagggcgagagccgcaagaccuucgucgagcugaugcggcgcggggaccuccccguguggcuggcccacaaggucgccuccgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacagcgacccccuggcgcucaaggaguucaaggacuucgccgccggccggaaguccaucgcccuggaccuggugaccgagaucgggcgcgucccgagccaccucgcccaccggacccgcaacgcgcuggacaaccuggugaugcuccacacgagcgagcacggcgggcgggccuaccgccacgccguggaggagcugcccgagaccauggagacccugcuccugcugggccucaugauccugcugaccgggggcgccaugcuguuccugaucuccggcaaggggaucggcaagacgagcaucgggcugaucugcgucaucgccuccagcggcaugcucuggauggcggacgugccccugcaguggaucgccuccgccaucgugcuggaguucuucaugaugguccuccugaucccggagcccgagaagcagcggacgccccaggacaaccagcuggccuacguggugaucgggauccucacccuggccgcgaucaucgccgccaacgagaugggccugcucgagaccacgaagcgcgaccugggcaugagcaaggagcccggggucguguccccgaccagcuaccuggacguggaccuccaccccgccuccgcguggacccuguacgccgucgccaccacggugaucacccccaugcugcggcacaccaucgagaacagcaccgccaacgugucccucgccgcgaucgccaaccaggccgucgugcugaugggccuggacaagggguggcccaucagcaagauggaccucggcgugccgcugcuggcccucgggugcuacucccaggucaacccccugacgcugaccgccgcggugcuccugcugaucacccacuacgccaucaucggccccggccuccaggccaaggccacccgcgaggcccagaagcggacggcggccgggaucaugaagaaccccaccguggacggcaucaugaccaucgaccuggacccggucaucuacgacagcaaguucgagaagcagcugggccaggugaugcuccuggugcugugcgccguccagcuccugcugaugcgcaccuccugggcccucugcgaggcgcugacgcuggccaccggccccaucaccacccucugggagggcagccccgggaaguucuggaacacgaccaucgccguguccauggccaacaucuuccggggcagcuaccuggccggggcgggccuggccuucuccaucaugaaguccguggggaccggcaagcgcggcaccgggagccagggcgagacccucggggagaaguggaagaagaagcugaaccagcugagccggaaggaguucgaccucuacaagaaguccggcaucacggaggucgaccgcaccgaggccaaggaggggcugaagcggggcgagaccacccaccacgccgugucccgcggcagcgccaagcugcagugguucguggagcggaacauggucauccccgaggggcgcgugaucgaccucggcugcgggcggggcgggugguccuacuacugcgcgggccugaagaaggugacggagguccgcggcuacaccaagggcgggccggggcacgaggagcccgugcccaugagcaccuacggcuggaacaucgugaagcugauguccgggaaggacgucuucuaccucccgcccgagaagugcgacacccugcugugcgacaucggcgagagcucccccagccccacgguggaggagucccgcaccauccgggugcugaagauggucgagcccuggcucaagaacaaccaguucugcaucaaggugcugaaccccuacaugcccaccgugaucgagcaccuggagcgccuccagcggaagcacggcgggaugcugguccgcaacccccugagccggaacuccacccacgagauguacuggaucagcaacggcacggggaacaucguguccagcgugaacauggucucccgccuccugcugaaccgguucaccaugacccaccgccggcccaccaucgagcgcgacguggaccucggcgccggcacgcggcacgugaacgccgagccggagauccccaacauggacgucaucggggagcgcaucaagcggaucaaggaggagcacaacagcaccuggcacuacgacgacgagaaccccuacaagaccugggccuaccacggcuccuacgaggugaaggccaccgggagcgcgagcuccaugaucaacggcgucgugaagcugcugacgaagccgugggacgugguccccauggugacccagauggccaugaccgacaccacgcccuucgggcagcagcgcguguucaaggagaaggucgacacccggacgccccggccgaugcccggcacccggaaggugauggagaucacggccgaguggcucuggcgcacccugggccggaacaagcgcccccgccugugcacccgggaggaguucaccaagaaggugcgcacgaacgccgcgaugggggccgucuucaccgaggagaaccagugggacagcgccaaggccgccguggaggacgaggaguucuggaagcucguggaccgggagcgcgagcugcacaagcugggcaagugcggguccugcgucuacaacaugaugggcaagcgggagaagaagcucggggaguucggcaaggcgaagggcagccgcgccaucugguacauguggcugggggcccgguaccuggaguucgaggcccucggcuuccugaacgaggaccacugguucucccgcgagaacagcuacuccgggguggagggcgaggggcugcacaagcucggcuacauccugcgggacaucagcaagauccccggcggggccauguacgcggacgacaccgccggcugggacacccgcaucacggaggacgaccugcacaacgaggagaagaucacccagcagauggacccggagcaccggcagcucgccaacgccaucuucaagcugaccuaccagaacaagguggucaaggugcagcgccccacccccaccgggacggugauggacaucaucucccggaaggaccagcgcggcagcggccaggucgggaccuacggccugaacaccuucaccaacauggaggcccagcucgugcggcagauggagggggaggacgugcuguccaaggcggaccuggagaacccccaccuccuggagaagaagaucacgcaguggcuggagaccaagggcgucgagcgccucaagcggauggccaucagcggggacgacugcguggugaagccgaucgacgaccgcuucgccaacgcccugcuggcccucaacgacaugggcaagguccggaaggacaucccccaguggcagcccuccaagggcuggcacgacuggcagcagguccccuucugcagccaccacuuccacgagcugaucaugaaggacgggcgcaagcugguggucccgugccggccccaggacgagcucaucggccgcgcgcgcaucucccagggggccggcuggagccugcgggagaccgccugccuggggaaggccuacgcgcagauguggucccucauguacuuccaccgccgggaccugcgccuggccagcaacgccaucugcuccgccgugcccgugcacuggguccccaccagccggacgaccuggagcauccacgcccaccaccaguggaugaccaccgaggacaugcucacgguguggaaccgcguguggaucgaggacaacccguggauggaggacaagacccccgucaccaccugggagaacgugcccuaccugggcaagcgggaggaccaguggugcggcucccugaucgggcucacgagccgcgcgaccugggcccagaacauccccaccgccauccagcagguccggucccugaucggcaacgaggaguuccuggacuacaugccgagcaugaagcgcuuccggaaggaggaggaguccgagggggccaucugguga

SEQ ID NO: 9984 - RNA, 9873 nt, Artificial Sequence
  derived and/or modified CDS sequence (opt1) from DENV-3__GQ252674__SS-prME
accagccugugccucaugaugauccugcccgccgcccuggcguuccaccucaccagccgggacggggagccgcggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcguggggaucggcaaccgcgacuucguggagggccuguccggggccaccugggucgacguggugcuggagcacggcgggugcgucaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgccaagaagcaggagguggucgugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggaggucuccgagacccagcacgggaccauccucaucaagguggaguacaagggcgaggacgcgccgugcaagauccccuucagcaccgaggacgggcagggcaaggcccacaacggccgccugaucacggccaaccccguggucaccaagaaggaggagcccgugaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgucggcggggugcucaacagccugggcaagauggugcaccagaucuucggguccgccuacacggcccuguucagcggcgucuccugggugaugaagaucggcaucggggugcuccugaccuggaucggccugaacagcaagaacaccuccaugagcuucuccugcaucgccaucgggaucaucacccucuaccugggcgccgucgugcaggcggacauggggugcgugaucaacuggaagggcaaggagcugaagugcggcagcgggaucuucgucacgaacgaggugcacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccgucguggugggggacaccaucggcguccucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgugugggaggucgaggacuacggguucggcguguucaccaccaacaucuggcucaagcugcgcgacguguacacccagcugugcgaccaccggcucaugagcgccgccgucaaggacgagcgcgccgugcacgcggacaugggcuacuggaucgagagccagaagaacggguccuggaagcuggagaaggccagccugaucgaggugaagacgugcaccuggccgaagucccacacccucuggagcaacggcguccuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccguggugaucaccgagaacugcgggacgcgcggccccagccuccggaccaccaccgucuccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaaggucgacaacuucaccaugggcgugcugugccucgcgauccuguucgaggaggugaugcgggggaaguucggcaagaagcacaugaucgccgggguccuguucaccuucgugcuccugcuguccggccagaucaccuggcgcgacauggcccacacgcucaucaugaucggcagcaacgccuccgaccggauggggaugggcgugaccuaccuggcccugaucgcgaccuucaagauccagcccuuccucgcccugggguucuuccugcgcaagcucaccagccgggagaaccugcugcucggcgucggccuggccauggccacgacccugcagcuccccgaggacaucgagcagauggcgaacgggaucgcccugggccugauggcccucaagcugaucacccaguucgagaccuaccagcuguggacggcccucgugagccugaccugcuccaacaccauccugacccucacgguggccuggcgcaccgcgacccugauccuggccggggucagccuccugccggugugccaguccagcuccaugcggaagaccgacuggcugcccaugacggucgccgccaugggcgugccgccccucccgcuguucaucuucagccugaaggacacccucaagcgccgcuccuggccccugaacgagggggugauggccgucggccuggugagcauccucgcguccagccugcugcggaacgacgugcccauggccggcccccucgucgccgggggccugcugaucgccugcuacgugaucaccgggaccuccgccgaccucacgguggagaacgcggccgacgucaccugggaggaggaggccgagcagaccggcgugagccacaaccugaugaucaccguggacgacgacgggaccaugcgcaucaaggacgacgagacggagaacauccugaccguccuccugaagaccgcccugcucaucguguccggcaucuucccguacagcauccccgccacccugcugguguggcacacguggcagaagcagacccagcgguccggcguccucugggacgugcccagcccgcccgagacccagaaggcggagcuggaggaggggguguaccgcaucaagcagcagggcaucuucgggaagacccaggucggcgugggggugcagaaggagggcgucuuccacacgauguggcacgugacccggggcgccgugcugacccacaacgggaagcgccucgagcccaacugggccuccgucaagaaggaccugaucagcuacggcgggggcuggcggcuguccgcccaguggcagcgcggggaggagguccaggugaucgcggucgagcccggcaagaaccccaagaacuuccagaccaugcccggcacguuccagaccaccaccggggagaucggcgccaucgcccuggacuucaagcccgggacgagcggcagccccaucaucaaccgggagggcaaggugguggggcucuacggcaacggggucgugaccaagaacggcggguacguguccggcaucgcccagaccaacgccgagccggacggccccacccccgagcuggaggaggagauguucaagaagcgcaaccugacgaucauggaccuccaccccgggagcggcaagacccggaaguaccugccggcgaucguccgcgaggccaucaagcggcgccugcggacccucauccuggcccccacccgcgugguggccgccgagauggaggaggcgcugaaggggcuccccauccgguaccagacgaccgccaccaaguccgagcacaccggccgcgagaucgucgaccugaugugccacgccacguucaccaugcggcugcucagccccgugcgcgugccgaacuacaaccugaucaucauggacgaggcccacuucaccgaccccgccuccaucgcggcccggggguacaucagcacccgcgucggcaugggcgaggccgccgcgaucuucaugacggccacgccgcccgggaccgccgacgccuucccgcaguccaacgcccccauccaggacgaggagcgcgacauccccgagcggagcuggaacuccggcaacgaguggaucaccgacuucgcggggaagacggugugguucgugcccagcaucaaggccggcaacgacaucgccaacugccugcgcaagaacgggaagaaggucauccagcucucccggaagaccuucgacaccgaguaccagaagaccaagcugaacgacugggacuucguggugacgaccgacaucagcgagaugggcgccaacuucaaggccgaccgcgucaucgacccgcggcgcugccugaagcccgugauccucaccgacggccccgagcgggugauccuggcggggcccaucccggucaccgccgccuccgccgcccagcgccggggccgcguggggcggaacccccagaaggagaacgaccaguacaucuucaccggccagccccugaacaacgacgaggaccacgcgcacuggacggaggccaagaugcuccuggacaacaucaacacccccgaggggaucaucccggcccuguucgagcccgagcgcgagaaguccgccgcgaucgacggcgaguaccggcucaagggcgagucccgcaagaccuucguggagcugaugcggcgcggggaccugcccgucuggcucgcccacaagguggccagcgagggcaucaaguacaccgaccggaaguggugcuucgacgggcagcgcaacaaccagauccuggaggagaacauggacgucgagaucuggacgaaggagggcgagaagaagaagcugcggccccgcuggcucgacgcccgcaccuacuccgacccgcuggcccugaaggaguucaaggacuucgcggccggccgcaagagcaucgcccucgaccuggugaccgagaucgggcgcgugcccucccaccuggcccaccggacccgcaacgcccucgacaaccuggucaugcugcacacgagcgagcacggcgggcgggcguaccgccacgccguggaggagcuccccgagaccauggagacccugcugcuccugggccugaugauccuccugaccgggggcgccaugcuguuccucaucagcggcaaggggaucggcaagacguccaucgggcugaucugcgugaucgccagcuccggcaugcuguggauggccgagaucccgcuccaguggaucgcgagcgccaucguccuggaguucuucaugauggugcugcucauccccgagcccgagaagcagcggacgccccaggacaaccagcuggccuacguggucaucgggauccugacccucgccgccaucaucgcggccaacgagaugggccugcuggagaccacgaagcgcgaccucggcauguccaaggagccggggguggugagccccaccuccuaccuggacgucgaccugcaccccgccagcgccuggacccucuacgcgguggccaccacggugaucacccccaugcugcggcacaccaucgagaacuccaccgccaacgucagccuggccgccaucgcgaaccaggccguggugcucaugggccuggacaagggguggccgaucuccaagauggaccugggcgucccccuccuggcccuggggugcuacagccaggugaacccccucacgcugaccgccgccgugcugcuccugaucacccacuacgcgaucaucggccccggccugcaggccaaggccacccgcgaggcccagaagcggacggccgcggggaucaugaagaacccgaccgucgacggcaucaugaccaucgaccucgaccccgugaucuacgacuccaaguucgagaagcagcugggccaggugaugcugcucguccugugcgccgugcagcugcuccugaugcgcaccagcugggcccugugcgaggcccucacgcuggcgaccggccccaucaccacccugugggagggcucccccgggaaguucuggaacacgaccaucgccgugagcauggccaacaucuuccggggcuccuaccucgccggggccggccuggcguucagcaucaugaaguccgucgggaccggcaagcgcggcaccgggagccagggcgagacccugggggagaaguggaagaagaagcucaaccagcugagccggaaggaguucgaccuguacaagaaguccggcaucacggagguggaccgcaccgaggccaaggaggggcucaagcggggcgagaucacccaccacgccgugagccgcggcuccgccaagcugcagugguucgucgagcggaacauggugaucccggaggggcgcgugaucgaccugggcugcgggcggggcggguggagcuacuacugcgccggccucaagaaggucaccgaggugcgcggcuacacgaagggcgggcccgggcacgaggagcccgugcccauguccaccuacggcuggaacaucgucaagcugaugagcgggaaggacguguucuaccugccgcccgagaagugcgacacccugcucugcgacaucggcgaguccagccccucccccaccguggaggagagccgcacgauccggguccugaagaugguggagccguggcugaagaacaaccaguucugcaucaaggugcucaaccccuacaugcccaccgucaucgagcaccuggagcgccugcagcggaagcacggcgggaugcucgugcgcaacccccugucccggaacagcacccacgagauguacuggaucuccaacggcaccgggaacaucgugagcuccgucaacauggugagccgccugcuccugaaccgguucacgaugacccaccgccggccgaccaucgagaaggacguggaccugggcgcgggcacccgccacgucaacgccgagcccgagacgcccaacauggacgugaucggggagcggaucaagcgcaucaaggaggagcacaacuccaccuggcacuacgacgacgagaacccguacaagaccugggccuaccacggcagcuacgaggugaaggccaccggguccgccagcagcaugaucaacggcgucgugaagcuccugacgaagcccugggacgucgugcccauggugacccagauggcgaugaccgacaccacgcccuucgggcagcagcgggucuucaaggagaagguggacacccgcaccccgcgguccaugcccggcacccgcaaggugaugggcaucacggccgaguggcuguggcggacccucgggcgcaacaagcggccccgccugugcacccgcgaggaguucaccaagaagguccggacgaacgccgccaugggcgcgguguucaccgaggagaaccagugggacagcgccaaggccgccguggaggacgaggaguucuggaagcuggucgaccgcgagcgggagcuccacaagcuggggaagugcggcuccugcguguacaacaugauggggaagcgcgagaagaagcugggcgaguucggcaaggccaaggggagccgggcgaucugguacauguggcucggcgcccgcuaccuggaguucgaggcccugggguuccucaacgaggaccacugguucucccgggacaacagcuacuccggcguggagggggagggccugcacaagcugggcuacauccuccgcgacaucagcaagauccccgggggcgccauguacgccgacgacaccgcggggugggacacccggaucacggaggacgaccugcacaacgaggagaagaucacccagcagauggacccggagcaccgccagcuggccaacgccaucuucaagcucaccuaccagaacaaggucgugaaggugcagcggcccacccccaccggcacggucauggacaucaucucccgcaaggaccagcggggcagcggccaggugggcaccuacgggcugaacaccuucaccaacauggaggugcagcugguccgccagauggagggcgagggggugcucuccaaggccgaccuggagaacccccaccuccccgagaagaagaucacgcaguggcuggagaccaagggcguggagcggcugaagcgcauggccaucagcggcgacgacugcgucgugaagcccaucgacgaccgguucgcgaacgcccugcucgcccugaacgacauggggaaggugcgcaaggacaucccccaguggcagcccuccaagggcuggcacgacuggcagcaggucccguucugcagccaccacuuccacgagcugaucaugaaggacgggcggaagcucguggugcccugccgcccccaggacgagcugaucggccgggcccgcaucucccagggggccggcuggagccugcgcgagaccgcgugccucggcaaggccuacgcccagauguggucccugauguacuuccaccggcgcgaccugcggcucgccagcaacgcgaucugcuccgccguccccgugcacugggugccgaccagccgcacgaccuggagcauccacgcccaccaccaguggaugaccaccgaggacaugcugacggucuggaaccggguguggaucgaggacaaccccuggauggagaacaagacccccgugaccaccugggagaacguccccuaccuggggaagcgcgaggaccaguggugcggcucccucaucgggcugacgagccgggccaccugggcccagaacaucccgaccgcgauccagcagguccgcucccugaucggcaacgaggaguuccucgacuacaugcccagcaugaagcgguuccgcaaggaggaggaguccgagggggccaucugguga

SEQ ID NO: 9985 - RNA, 9873 nt, Artificial Sequence
  derived and/or modified CDS sequence (opt1) from DENV-3__GQ199889__SS-prME
accagccugugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccaccccggguucaccauccucgcgcuguuccuggcccacuacaucggcaccucccucacccagaagguggugaucuucauccugcugauccucgucacgcccagcauggccaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccauccugcccgaggagcaggaccagaacuacgugugcaagcacacguacgucgaccggggguggggcaacgggugcggccucuucgggaagggcucccuggugaccugcgccaaguuccagugccuggagagcaucgagggcaaggugguccaguacgagaaccucaaguacaccgugaucaucaccgugcacacgggggaccagcaccaggucggcaacgagacccagggggugaccgccgagaucacgccccaggcguccacgaccgaggccauccugcccgaguacggcacccuggggcucgagugcagcccccgcaccggccuggacuucaacgagaugauccugcucaccaugaagaacaaggccuggaugguccaccggcagugguucuucgaccugccgcugcccuggacguccggcgccaccaccgagacccccacguggaaccgcaaggagcuccuggugaccuucaagaacgcccacgcgaagaagcaggagguggucgugcuggggagccaggagggcgccaugcacaccgcccucaccggggccacggagauccagaacuccggcgggaccagcaucuucgccggccaccugaagugccggcugaagauggacaagcucgagcugaagggcauguccuacgcgaugugcaccaacaccuucgugcugaagaaggaggucagcgagacgcagcacgggaccauccucaucaagguggaguacaagggcgaggacgcccccugcaagauccccuucagcaccgaggacgggcagggcaaggcccacaacggccgccugaucaccgccaaccccguggucacgaagaaggaggagcccgugaacaucgaggcggagcccccguucggggaguccaacaucgugaucggcaucggggacaacgcccugaagaucaacugguacaagaagggcagcuccaucgggaagauguucgaggccaccgcccggggcgcccgccggauggcgauccugggcgacaccgccugggacuucgggagcgucggcggggugcucaacucccugggcaagauggugcaccagaucuucgggagcgccuacaccgcccuguucuccggcgucagcugggugaugaagaucggcaucggggugcuccugacguggaucggccugaacuccaagaacaccagcauguccuucagcugcaucgccaucgggaucaucacccucuaccugggcgcggucgugcaggccgacaccgggugcgugaucaacuggaagggcaaggagcugaagugcggcuccgggaucuucgucacgaacgaggugcacaccuggaccgagcaguacaaguuccaggccgacagccccaagcgccucgccaccgccaucgcgggcgccugggagaacggggugugcggcauccgcuccacgacccggauggagaaccugcuguggaagcagaucgccaacgagcucaacuacauccugugggagaacaacaucaagcugaccgucguggugggggacaccaucggcguccucgagcagggcaagcgcacgcugacgccccagcccauggagcugaaguacagcuggaagaccugggggaaggccaagaucgugaccgcggagauccagaacuccagcuucaucaucgacggcccgaacacgcccgagugccccuccgccagccgggccuggaacgugugggaggucgaggacuacggguucggcguguucaccaccaacaucuggcucaagcugcgcgagguguacacccagcugugcgaccaccggcucaugagcgccgccgucaaggacgagcgcgcggugcacgccgacaugggcuacuggaucgagucccagaagaacgggagcuggaagcuggagaaggccuccuucaucgaggugaagaccugcacguggcccaagagccacacccugugguccaacggcguccucgagagcgacaugaucaucccgaagucccuggccgggcccaucagccagcacaacuaccggcccggcuaccacacccagaccgccgggccguggcaccugggcaagcucgagcuggacuucaacuacugcgagggcacgaccguggugaucaccgagaacugcgggacccgcggccccucccugcggacgaccaccgucagcgggaagcucauccacgaguggugcugccgcuccugcacccugccgccccugcgguacaugggcgaggacgggugcugguacggcauggagauccgcccgaucagcgagaaggaggagaacauggugaagucccucgcgagcgccggcuccgggaagguggacaacuucacgaugggcguccugugccuggccauccucuucgaggaggugaugcgggggaaguucggcaagaagcacaugaucgccgggguguucuucaccuucguccugcugcucagcggccagaucaccuggcgcgacauggcccacacccugaucaugaucggcuccaacgcgagcgaccggauggggaugggcgugacguaccuggcccucaucgccaccuucaagauccagcccuuccuggcccugggguucuuccuccgcaagcugaccagccgggagaaccugcuccugggcgugggccuggcgauggccaccacgcuccagcugcccgaggacaucgagcagauggccaacgggaucgcccugggccucauggcccugaagcugaucacccaguucgagaccuaccagcucuggaccgcgcugaucucccugacgugcagcaacaccauguucacccucaccgucgccuggcgcacggccacccugauccuggccggggugucccuccugcccgugugccagagcuccagcaugcggaagaccgacuggcugccgaugaccgucgccgcgaugggcgugccgccccugccccuguucaucuucucccugaaggacacgcucaagcgccgcagcuggccgcugaacgagggggucauggccgugggccugguguccauccucgccagcucccugcugcggaacgacguccccauggccggcccccucguggccgggggcaugcugaucgcgugcuacgugaucaccgggaccagcgccgaccugaccgucgagaaggccgccgacgugacgugggaggaggaggccgagcagaccggcgugucccacaaccucaugaucaccgucgacgacgacgggaccaugcgcaucaaggacgacgagaccgagaacauccugacggugcugcucaagaccgcgcugcugaucgugagcggcaucuuccccuacuccaucccggccacccuccuggucuggcacaccuggcagaagcagacgcagcggagcggcgugcugugggacgugcccagcccgcccgagacccagaaggccgagcucgaggagggggucuaccgcaucaagcagcagggcauccuggggaagacccaggugggcguggggguccagaaggagggcguguuccacaccauguggcacgugacgcggggcgccguccugacccacaacgggaagcgccucgagccgaacugggcgagcgugaagaaggaccugaucuccuacggcgggggcuggcggcugagcgcccaguggcagaagggggaggaggugcaggucaucgccguggagcccggcaagaaccccaagaacuuccagaccaugcccggcaccuuccagacgaccaccggggagaucggcgccaucgcccucgacuucaagccggggaccagcggcucccccaucaucaaccgcgagggcaagguggucgggcuguacggcaacgggguggugacgaagaacggcggguacgucagcggcaucgcgcagaccuccgccgagcccgacggcccgacccccgagcuggaggaggagauguuccggaagcgcaaccugaccaucauggaccuccaccccgggagcggcaagacgcggaaguaccugcccgccaucgugcgcgaggccaucaagcggcgccugcggacccucauccuggccccgacccgcguggucgcggccgagauggaggaggcccugaaggggcuccccauccgguaccagaccacggccaccaaguccgagcacaccggccgcgagaucguggaccugaugugccacgccaccuucacgaugcggcugcucagccccgugcgcguccccaacuacaaccugaucaucauggacgaggcgcacuucaccgacccggccuccaucgccgcccggggguacaucagcacccgcgugggcaugggcgaggcggccgccaucuucaugaccgccacgccgcccgggaccgccgacgcguucccccaguccaacgccccgauccaggacgaggagcgcgacauccccgagcggagcuggaacuccggcaacgaguggaucaccgacuucgccgggaagaccgugugguucguccccagcaucaaggccggcaacgacaucgccaacugccugcgcaagaacgggaagaaggugauccagcucucccggaagacguucgacaccgaguaccagaagaccaagcugaacgacugggacuucguggucaccacggacaucagcgagaugggcgcgaacuucaaggccgaccgcgugaucgacccccggcgcugccugaagccggugauccucaccgacggccccgagcgggucauccuggccgggcccaugcccgugaccgccgccuccgcggcccagcgccggggccgcguggggcggaacccgcagaaggagaacgaccaguacaucuucaccggccagccccugaacaacgacgaggaccacgcccacuggaccgaggccaagaugcuccuggacaacaucaacacgcccgaggggaucauccccgcgcuguucgagccggagcgcgagaaguccgccgccaucgacggcgaguaccggcucaagggcgagagccgcaagaccuucgucgagcugaugcggcgcggggaccugcccguguggcucgcccacaagguggccagcgagggcaucaaguacaccgaccggaaguggugcuucgacgggcagcgcaacaaccagauccuggaggagaacauggacgucgagaucuggaccaaggagggcgagaagaagaagcugcggccccgcuggcucgacgcgcgcacguacuccgacccccuggcccugaaggaguucaaggacuucgccgccggccggaaguccaucgcccucgaccuggugaccgagaucgggcgcgucccgagccaccuggcgcaccggacccgcaacgcccucgacaaccuggugaugcugcacaccuccgagcacggcgggcgggccuaccgccacgccguggaggagcuccccgagacgauggagacccugcugcuccugggccugaugauccuccugaccgggggcgccaugcuguuccucaucagcggcaaggggaucggcaagaccuccaucgggcugaucugcgucaucgcgagcuccggcaugcuguggauggccgacgugccccuccaguggaucgccagcgccaucgugcuggaguucuucaugaugguccugcucaucccggagcccgagaagcagcggacgccccaggacaaccagcuggccuacguggugaucgggauccugacccucgcggccaucaucgccgccaacgagaugggccugcuggagaccaccaagcgcgaccucggcauguccaaggagcccggggucgugagcccgacguccuaccuggacguggaccugcaccccgcgagcgccuggacccucuacgccgucgccaccaccgugaucacgcccaugcugcggcacaccaucgagaacuccaccgccaacgugagccuggcggccaucgccaaccaggccgucgugcucaugggccuggacaagggguggcccaucuccaagauggaccugggcgugccgcuccuggcccuggggugcuacagccaggucaacccccucacccugacggcggccgugcugcuccugaucacccacuacgccaucaucggccccggccugcaggccaaggccacccgcgaggcgcagaagcggaccgccgccgggaucaugaagaaccccacgguggacggcaucaugaccaucgaccucgacccggucaucuacgacuccaaguucgagaagcagcugggccaggugaugcugcucgugcugugcgccguccagcugcuccugaugcgcaccagcugggcgcugugcgaggcccucacccuggccacgggccccaucaccacccugugggagggcucccccgggaaguucuggaacaccacgaucgccgugagcauggccaacaucuuccggggcuccuaccucgcgggggccggccuggccuucagcaucaugaaguccguggggaccggcaagcgcggcaccgggucccagggcgagacccugggggagaaguggaagaagaagcucaaccagcugagccggaaggaguucgaccuguacaagaaguccggcaucaccgaggucgaccgcacggaggccaaggaggggcucaagcggggcgagaccacccgccacgccgugagccggggcuccgcgaagcugcagugguucguggagcgcaacauggucauccccgaggggcgggugaucgaccugggcugcgggcgcggcggguggagcuacuacugcgccggccucaagaaggugaccgagguccgcggcuacacgaagggcgggccggggcacgaggagcccgugcccauguccaccuacggcuggaacaucgugaagcugaugagcgggaaggacgucuucuaccugcccccggagaagugcgacacccuccugugcgacaucggcgaguccagccccucccccaccguggaggagagccggacgauccgcgugcugaagauggucgagcccuggcugaagaacaaccaguucugcaucaaggugcucaacccguacaugcccaccgugaucgagcaccuggagcggcugcagcgcaagcacggcgggaugcucguccggaacccccugucccgcaacagcacccacgagauguacuggaucuccaacggcaccgggaacaucgugagcuccgugaacauggucagccggcugcuccugaaccgcuucacgaugacccaccggcgccccaccaucgagcgggacguggaccugggcgccggcacccgccacgugaacgccgagccggagauccccaacauggacgucaucggggagcggaucaagcgcaucaaggaggagcacaacuccacguggcacuacgacgacgagaaccccuacaagaccugggccuaccacggcagcuacgaggugaaggcgaccgggagcgccuccagcaugaucaacggcguggucaagcuccugaccaagccgugggacgugguccccauggugacgcagauggccaugaccgacaccacccccuucgggcagcagcggguguucaaggagaaggucgacacgcgcacgccccggccgaugcccggcacccgcaaggugauggagaucaccgccgaguggcuguggcggacgcucggccgcaacaagcgcccccggcugugcacccgcgaggaguucaccaagaaggugcggaccaacgcggccaugggggccgucuucacggaggagaaccagugggacuccgccaaggccgcgguggaggacgaggaguucuggaagcugguggaccgcgagcgggagcuccacaagcugggcaagugcgggagcugcgucuacaacaugaugggcaagcgcgagaagaagcugggggaguucggcaaggccaagggcucccgggccaucugguacauguggcucggggcccgcuaccuggaguucgaggcccugggcuuccucaacgaggaccacugguucagccgggagaacuccuacagcgggguggagggcgaggggcugcacaagcugggcuacauccuccgcgacaucuccaagauccccggcggggcgauguacgccgacgacaccgccggcugggacacccggaucaccgaggacgaccugcacaacgaggagaagaucacgcagcagauggacccggagcaccgccagcuggccaacgccaucuucaagcucaccuaccagaacaagguggucaaggugcagcggcccacccccaccgggaccgugauggacaucaucagccgcaaggaccagcggggcuccggccaggucgggacguacggccugaacaccuucaccaacauggaggcgcagcuggugcgccagauggagggggagggcgugcucagcaaggccgaccuggagaacccccaccuccucgagaagaagaucacccaguggcuggagacgaagggggucgagcggcugaagcgcauggccaucuccggcgacgacugcguggugaagccgaucgacgaccgguucgccaacgcccuccuggcgcugaacgacaugggcaagguccgcaaggacaucccccaguggcagcccagcaagggguggcacgacuggcagcagguccccuucugcucccaccacuuccacgagcucaucaugaaggacggccggaagcugguggucccgugccgcccccaggacgagcugaucgggcgcgcccggaucagccagggcgccggguggucccuccgcgagaccgccugccugggcaaggcguacgcccagauguggagccugauguacuuccaccggcgcgaccuccggcuggccuccaacgccaucugcagcgccgugcccgugcacuggguccccaccagccgcaccacgugguccauccacgcgcaccaccaguggaugaccaccgaggacaugcugaccguguggaaccggguguggaucgaggacaacccguggauggaggacaagacgcccgucaccaccugggagaacgugcccuaccucggcaagcgcgaggaccaguggugcgggagccugaucggccugaccucccgggccacgugggcccagaacauccccaccgccauccagcagguccgcagccucaucgggaacgaggaguuccuggacuacaugccguccaugaagcgguuccgcaaggaggaggagagcgagggcgccaucugguga

SEQ ID NO: 9986 - RNA, 9873 nt, Artificial Sequence
  derived and/or modified CDS sequence (opt1) from DENV-3__FJ882571__SS-prME
accagccucugccucaugaugauccugcccgccgcccuggcguuccaccucaccagccgggacggcgagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaccaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcucaagcugcgcgacgucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccguggucaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccuggucuccgccggcagcgggaagguggacaacuucaccaugggcgugcugugccucgcgauccuguucgaggaggucaugcgggggaaguucggcaagaagcacaugaucgccggggugcuguucaccuucgugcuccugcuguccggccagaucaccuggcgcgacauggcccacacgcucaucaugaucggcagcaacgccuccgaccggauggggaugggcgucaccuaccuggcccugaucgcgaccuucaagauccagcccuuccucgcccugggguucuuccugcgcaagcucaccagccgggagaaccugcugcucggcgugggccuggccauggccacgacccugcagcuccccgaggacaucgagcagauggcgaacgggaucgcccugggccugauggcccucaagcugaucacccaguucgagaccuaccagcuguggacggcccucgugagccugaccugcuccaacaccauccugacccucacggucgccuggcgcaccgcgacccugauccuggccggggugagccuccugccggucugccaguccagcuccaugcggaagaccgacuggcugcccaugacgguggccgccaugggcgugccgccccucccgcuguucaucuucagccugaaggacacccucaagcgccgcuccuggccccugaacgagggggucauggccgugggccuggugagcauccucgcguccagccugcugcggaacgacguccccauggccggcccccucguggccgggggccugcugaucgccugcuacgugaucaccgggaccuccgccgaccucaucgucgagaaggcggccgacgugacgugggaggaggaggccgagcagaccggcgugagccacaaccugaugaucaccgucgacgacgacgggaccaugcgcaucaaggacgacgagaccgagaacauccugacggugcuccugaagaccgcccugcucaucguguccggcaucuucccguacagcauccccgccacccugcuggucuggcacaccuggcagaagcagacgcagcgguccggcgugcucugggacgugcccagcccgcccgagacccagaaggcggagcuggaggagggggucuaccgcaucaagcagcagggcauccuggggaagacccaggugggcguggggguccagaaggagggcguguuccacaccauguggcacgugacgcggggcgccguccucacccacaacgggaagcgccuggagcccaacugggccuccgugaagaaggaccugaucagcuacggcgggggcuggcggcuguccgcccaguggcagaagggggaggaggugcaggucaucgcgguggagcccggcaagaaccccaagaacuuccagaccaugcccggcaccuuccagacgaccaccggggagaucggcgccaucgcccucgacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggcgaucgugcgggaggccaucaagcgccggcuccgcacccugauccuggcccccacccggguggucgccgccgagauggaggaggcgcucaaggggcugcccauccgcuaccagaccacggccaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgcggcccgcggguacaucagcacccgggugggcaugggcgaggccgccgcgaucuucaugaccgccacgccgcccgggaccgccgacgccuucccgcaguccaacgcccccauccaggacgaggagcgcgacauccccgagcgcagcuggaacuccggcaacgaguggaucaccgacuucgcggggaagaccgugugguucguccccagcaucaaggccggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggcggggcccaugccggugaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacgcccgaggggaucaucccggcccucuucgagcccgagcgggagaaguccgccgcgaucgacggcgaguaccgccugaagggcgagucccggaagaccuucgucgagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgcggccggccgcaagagcaucgcccuggaccuggugaccgagaucgggcggguccccucccaccucgcccaccgcacccggaacgcccuggacaaccuggugaugcuccacaccagcgagcacggcgggcgcgcguaccggcacgccguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgcgagcgccaucgugcuggaguucuucaugauggugcuccugauccccgagcccgagaagcagcgcacgccccaggacaaccagcuggccuacgucgugaucgggauccucacccuggccgccaucaucgcggccaacgagaugggccugcucgagaccaccaagcgggaccugggcauguccaaggagccggggguggucagccccacguccuaccuggacguggaccuccaccccgccagcgccuggacccuguacgcgguggccaccaccgucaucacgcccaugcugcgccacaccaucgagaacuccaccgccaacgugagccucgccgccaucgcgaaccaggccgugguccugaugggccuggacaagggguggccgaucuccaagauggaccucggcgugccccugcuggcccucgggugcuacagccaggugaacccccugacccugacggccgccguccuccugcugaucacccacuacgcgaucaucggccccggccuccaggccaaggccacccgggaggcccagaagcgcaccgccgcggggaucaugaagaacccgacgguggacggcaucaugaccaucgaccuggaccccgugaucuacgacuccaaguucgagaagcagcuggggcaggucaugcuccuggugcugugcgccgugcagcuccugcugaugcggaccagcugggcccucugcgaggcccugacccuggcgacgggccccaucaccacccucugggagggcucccccgggaaguucuggaacaccacgaucgccgucagcauggccaacaucuuccgcggcuccuaccuggccggggccggccuggcguucagcaucaugaaguccguggggaccggcaagcggggcaccgggagccagggcgagacccucggggagaaguggaagaagaagcugaaccagcugagccgcaaggaguucgaccucuacaagaaguccggcaucaccgagguggaccggacggaggccaaggaggggcugaagcgcggcgagaucacccaccacgccgucagccggggcuccgccaagcugcagugguucguggagcgcaacauggugaucccggaggggcgggucaucgaccucggcugcgggcgcggcggguggagcuacuacugcgccggccugaagaaggugaccgaggugcggggcuacaccaagggcgggcccgggcacgaggagcccguccccauguccacguacggcuggaacaucgugaagcugaugagcgggaaggacguguucuaccugccgcccgagaagugcgacacccuccugugcgacaucggcgaguccagccccucccccaccgucgaggagagccgcaccauccgcgugcugaagaugguggagccguggcucaagaacaaccaguucugcaucaagguccugaaccccuacaugcccacggugaucgagcaccuggagcggcuccagcgcaagcacggcgggaugcuggugcggaacccccugucccgcaacagcacccacgagauguacuggaucuccaacggcaccgggaacaucgucagcuccgugaacauggugagccggcuccugcugaaccgcuucaccaugacgcaccggcgcccgaccaucgagaaggacgucgaccucggcgcgggcacccggcacgugaacgccgagcccgagacccccaacauggacgugaucggggagcgcaucaagcggaucaaggaggagcacaacuccacguggcacuacgacgacgagaacccguacaagaccugggccuaccacggcagcuacgaggucaaggccaccggguccgccagcagcaugaucaacggcguggucaagcugcugaccaagcccugggacguggugcccauggucacgcagauggcgaugaccgacaccacccccuucgggcagcagcgcguguucaaggagaagguggacacgcggaccccgcgccccaugcccggcacccggaaggucaugggcaucaccgccgaguggcucuggcgcacgcuggggcggaacaagcgcccccggcugugcacccgcgaggaguucaccaagaaggugcgcaccaacgccgccaugggcgcgguguucacggaggagaaccagugggacuccgccaaggccgccgucgaggacgaggaguucuggaagcucguggaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgacaacuccuacagcggcgucgagggggagggccugcacaagcucggcuacauccugcgggacaucuccaagauccccggcggggccauguacgccgacgacaccgcggggugggacacccgcaucaccgaggacgaccugcacaacgaggagaagaucacgcagcagauggaccccgagcaccggcagcucgccaacgccaucuucaagcugaccuaccagaacaagguggugaagguccagcgccccacccccaccgggaccgugauggacaucaucagccggaaggaccagcgcggcuccggccaggugggcacguacgggcugaacaccuucaccaacauggagguccagcucgugcggcagauggagggcgagggggugcugagcaaggccgaccuggagaacccgcaccuccccgagaagaagaucacccaguggcuggagacgaagggcgucgagcgccugaagcggauggccaucuccggcgacgacugcguggugaagcccaucgacgaccgcuucgcgaacgcccuccuggcccugaacgacauggggaagguccggaaggacaucccccaguggcagccgagcaagggcaugcacgacuggcagcagguccccuucugcucccaccacuuccacgagcucaucaugaaggacgggcgcaagcuggugguccccugccggccccaggacgagcugaucggccgcgcccggaucagccagggggccggcuggucccuccgcgagaccgcgugccugggcaaggccuacgcccagauguggagccugauguacuuccaccgccgggaccuccgccuggccuccaacgcgaucugcagcgccgugccggugcacuggguccccaccucccggaccacguggagcauccacgcccaccaccaguggaugaccaccgaggacaugcuggccguguggaaccgcguguggaucgaggacaaccccuggauggaggacaagacccccgucacgaccugggaggacgugccguaccucgggaagcgggaggaccaguggugcggcagccugaucgggcugaccucccgcgccaccugggcgcagaacauccucacggccauccagcagguccggagccugaucggcaacgaggaguuccuggacuacaugcccuccaugaagcgcuuccggaaggaggaggagagcgagggggccaucugguga

SEQ ID NO: 9987 - RNA, 9873 nt, Artificial Sequence
  derived and/or modified CDS sequence (opt1) from DENV-3__FJ882572__SS-prME
accagccugugccucaugaugauccugcccgccgcccuggcguuccaccucaccagccgcgacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcggcaggucgagaaggucgagaccugggcccugcgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugcccgaggagcaggaccagaacuacgucugcaagcacaccuacguggaccggggguggggcaacgggugcggccucuucgggaagggcucccuggugaccugcgccaaguuccagugccuggagagcaucgagggcaaggucgugcaguacgagaaccucaaguacaccgugaucaucacgguccacaccggggaccagcaccaggugggcaacgagacccagggggucaccgccgagaucacgccccaggccuccaccaccgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaaccgcaaggagcuccuggugaccuucaagaacgcccacgccaagaagcaggaggucguggugcuggggagccaggagggcgcgaugcacaccgcccucacgggggccaccgagauccagaacuccggcgggaccagcaucuucgccggccaccugaagugccggcugaagauggacaagcucgagcugaagggcauguccuacgccaugugcaccaacacguucguccugaagaaggaggugagcgagacccagcacgggaccauccucaucaagguggaguacaagggcgaggacgcgcccugcaagauccccuucagcaccgaggacgggcagggcaaggcccacaacggccgccugaucacggccaaccccgucgugaccaagaaggaggagcccgugaacaucgaggccgagcccccguucggggaguccaacaucgucaucggcaucggggacaacgcgcugaagaucaacugguacaagaagggcagcuccaucgggaagauguucgaggccaccgcccggggcgcccgccggauggccauccugggcgacaccgcgugggacuucgggagcgugggcggggugcucaacucccugggcaagaugguccaccagaucuucgggagcgccuacacggcccuguucuccggcgugagcugggugaugaagaucggcaucgggguccuccugaccuggaucggccugaacuccaagaacaccagcauguccuucagcugcaucgccaucgggaucaucacccucuaccugggcgccguggugcaggcggacacggggugcgucaucaacuggaagggcaaggagcugaagugcggcuccgggaucuucgugaccaacgaggugcacaccuggaccgagcaguacaaguuccaggccgacagccccaagcgccucgccacggccaucgccggcgcgugggagaacggggucugcggcauccgcuccaccacccggauggagaaccugcuguggaagcagaucgccaacgagcucaacuacauccugugggagaacaacaucaagcugaccgugguggucggggacacgaucggcgugcucgagcagggcaagcgcacccugacgccccagcccauggagcugaaguacagcuggaagaccugggggaaggccaagaucgugacggccgagauccagaacuccagcuucaucaucgacggcccgaacacccccgagugccccuccgcgagccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagucccagaagaacgggagcuggaagcuggagaaggccuccuucaucgaggucaagacgugcaccuggcccaagagccacacccugugguccaacggcgugcucgagagcgacaugaucaucccgaagucccuggccgggcccaucagccagcacaacuaccggcccggcuaccacacccagacggccgggccguggcaccugggcaagcucgagcuggacuucaacuacugcgagggcaccaccguggucaucaccgagaacugcgggacgcgcggccccucccugcggaccaccaccgugagcgggaagcucauccacgaguggugcugccgcuccugcacgcugccgccccugcgguacaugggcgaggacgggugcugguacggcauggagauccgcccgaucagcgagaaggaggagaacauggugaagucccucgccagcgcgggcuccgggaaggucgacaacuucaccaugggcgugcugugccuggccauccucuucgaggaggugaugcgggggaaguucggcaagaagcacaugaucgccggggucuucuucaccuucgugcugcugcucagcggccagaucaccuggcgcgacauggcccacacgcugaucaugaucggcuccaacgccagcgaccggauggggaugggcgugaccuaccuggcgcucaucgccaccuucaagauccagcccuuccuggcccugggguucuuccuccgcaagcugaccagccgggagaaccugcuccugggcgucggccuggccauggcgacgacccuccagcugcccgaggacaucgagcagauggccaacgggaucgcccugggccucauggcccugaagcugaucacccaguucgagaccuaccagcucuggacggcccugaucucccugaccugcagcaacaccauguucacccucacgguggcguggcgcaccgccacccugauccuggccggggugucccuccugcccgucugccagagcuccagcaugcggaagaccgacuggcugccgaugacgguggccgccaugggcgugccgccccugccccuguucaucuucucccugaaggacacccucaagcgccgcagcuggccgcugaacgagggggugauggcggugggccuggucuccauccucgccagcucccugcugcggaacgacgugcccauggccggcccccucguggccgggggcaugcugaucgccugcuacgucaucaccgggaccagcgcggaccugacgguggagaaggccgccgacgugaccugggaggaggaggccgagcagaccggcgucucccacaaccucaugaucaccguggacgacgacgggaccaugcgcaucaaggacgacgagacggagaacauccugaccgugcugcucaagaccgcccugcugaucgucagcggcaucuuccccuacuccaucccggcgacccuccugguguggcacacguggcagaagcagacccagcggagcggcgugcugugggacguccccagcccgcccgagacccagaaggccgagcucgaggaggggguguaccgcaucaagcagcagggcauccuggggaagacccaggugggcgucggggugcagaaggagggcguguuccacacgauguggcacgucacccggggcgccgugcugacccacaacgggaagcgccucgagccgaacugggccagcgugaagaaggaccugaucuccuacggcgggggcuggcggcugagcgcgcaguggcagaagggggaggagguccaggugaucgccguggagcccggcaagaaccccaagaacuuccagaccaugcccggcacguuccagaccaccaccggggagaucggcgccaucgcccucgacuucaagccggggacgagcggcucccccaucaucaaccgcgagggcaaggucguggggcuguacggcaacgggguggucaccaagaacggcggguacgugagcggcaucgcccagaccuccgcggagcccgacggcccgacccccgagcuggaggaggagauguuccggaagcgcaaccugacgaucauggaccuccaccccgggagcggcaagacccggaaguaccugcccgccaucgugcgcgaggccaucaagcggcgccugcggacccucauccuggccccgacccgcgucguggccgcggagauggaggaggcccugaaggggcuccccauccgguaccagacgaccgccaccaaguccgagcacaccggccgcgagaucguggaccugaugugccacgccacguucaccaugcggcugcucagccccguccgcgugcccaacuacaaccugaucaucauggacgaggcccacuucaccgacccggcguccaucgccgcccggggguacaucagcacccgcgugggcaugggcgaggccgcggccaucuucaugacggccacgccgcccgggaccgccgacgccuucccccaguccaacgcgccgauccaggacgaggagcgcgacauccccgagcggagcuggaacuccggcaacgaguggaucaccgacuucgccgggaagacggucugguucgugcccagcaucaaggccggcaacgacaucgccaacugccugcgcaagaacgggaagaaggugauccagcucucccggaagaccuucgacaccgaguaccagaagaccaagcugaacgacugggacuucgucgugacgaccgacaucagcgagaugggcgccaacuucaaggcggaccgcgugaucgacccccggcgcugccugaagccggucauccucaccgacggccccgagcgggugauccuggccgggcccaugcccgugaccgccgccuccgccgcgcagcgccggggccgcgucgggcggaacccgcagaaggagaacgaccaguacaucuucaccggccagccccugaacaacgacgaggaccacgcccacuggacggaggccaagaugcuccuggacaacaucaacacccccgaggggaucauccccgcccuguucgagccggagcgcgagaaguccgcggccaucgacggcgaguaccggcucaagggcgagagccgcaagaccuucguggagcugaugcggcgcggggaccugcccguguggcucgcccacaaggucgccagcgagggcaucaaguacaccgaccggaaguggugcuucgacgggcagcgcaacaaccagauccuggaggagaacauggacguggagaucuggacgaaggagggcgagaagaagaagcugcggccccgcuggcucgacgcccgcaccuacuccgacccccuggcgcugaaggaguucaaggacuucgccgccggccggaaguccaucgcccucgaccuggucaccgagaucgggcgcgugccgagccaccuggcccaccggacccgcaacgcgcucgacaaccuggugaugcugcacacguccgagcacggcgggcgggccuaccgccacgccgucgaggagcuccccgagaccauggagacccugcugcuccugggccugaugauccuccugaccgggggcgccaugcuguuccucaucagcggcaaggggaucggcaagacguccaucgggcugaucugcgugaucgccagcuccggcaugcuguggauggcggacgugccccuccaguggaucgccagcgccaucguccuggaguucuucaugauggugcugcucaucccggagcccgagaagcagcggacgccccaggacaaccagcuggccuacguggucaucgggauccugacccucgccgcgaucaucgccgccaacgagaugggccugcuggagaccacgaagcgcgaccucggcauguccaaggagcccgggguggugagcccgaccuccuaccuggacgucgaccugcaccccgccagcgcguggacccucuacgccguggccaccacggugaucacccccaugcugcggcacaccaucgagaacuccaccgccaacgucagccuggccgcgaucgccaaccaggccguggugcucaugggccuggacaagggguggcccaucuccaagauggaccugggcgucccgcuccuggcccuggggugcuacagccaggugaacccccucacgcugaccgccgcggugcugcuccugaucacccacuacgccaucaucggccccggccugcaggccaaggccacccgcgaggcccagaagcggacggcggccgggaucaugaagaaccccaccgucgacggcaucaugaccaucgaccucgacccggugaucuacgacuccaaguucgagaagcagcugggccaggugaugcugcucguccugugcgccgugcagcugcuccugaugcgcaccagcugggcccugugcgaggcgcucacgcuggccaccggccccaucaccacccugugggagggcucccccgggaaguucuggaacacgaccaucgccgugagcauggccaacaucuuccggggcuccuaccucgccggggcgggccuggccuucagcaucaugaaguccgucgggaccggcaagcgcggcaccgggucccagggcgagacccugggggagaaguggaagaagaagcucaaccagcugagccggaaggaguucgaccuguacaagaaguccggcaucacggagguggaccgcaccgaggccaaggaggggcucaagcggggcgagaccacccaccacgccgugagccgcggcuccgccaagcugcagugguucgucgagcggaacauggugauccccgaggggcgcgugaucgaccugggcugcgggcggggcggguggagcuacuacugcgcgggccucaagaaggucacggaggugcgcggcuacaccaagggcgggccggggcacgaggagcccgugcccauguccaccuacggcuggaacaucgucaagcugaugagcgggaaggacguguucuaccugcccccggagaagugcgacacccuccugugcgacaucggcgaguccagccccucccccacgguggaggagagccgcaccauccggguccugaagaugguggagcccuggcugaagaacaaccaguucugcaucaaggugcucaacccguacaugcccaccgucaucgagcaccuggagcgccugcagcggaagcacggcgggaugcucgugcgcaacccccugucccggaacagcacccacgagauguacuggaucuccaacggcacggggaacaucgugagcuccgucaacauggugagccgccugcuccugaaccgguucaccaugacccaccgccggcccaccaucgagcgcgacguggaccugggcgccggcacgcggcacgucaacgccgagccggagauccccaacauggacgugaucggggagcgcaucaagcggaucaaggaggagcacaacuccaccuggcacuacgacgacgagaaccccuacaagaccugggccuaccacggcagcuacgaggugaaggccaccgggagcgcguccagcaugaucaacggcgucgugaagcuccugacgaagccgugggacgucgugcccauggugacccagauggccaugaccgacaccacgcccuucgggcagcagcgcgucuucaaggagaagguggacacccggacgccccgcccgaugcccggcacccggaaggugauggagaucacggccgaguggcuguggcgcacccucggccggaacaagcgcccccgccugugcacccgggaggaguucaccaagaagguccgcacgaacgccgcgaugggggccguguucaccgaggagaaccagugggacuccgccaaggccgccguggaggacgaggaguucuggaagcuggucgaccgggagcgcgagcuccacaagcugggcaagugcgggagcugcguguacaacaugaugggcaagcgggagaagaagcugggggaguucggcaaggcgaagggcucccgcgccaucugguacauguggcucggggcccgguaccuggaguucgaggcccugggcuuccucaacgaggaccacugguucagccgcgagaacuccuacagcgggguggagggcgaggggcugcacaagcugggcuacauccuccgggacaucuccaagauccccggcggggccauguacgcggacgacaccgccggcugggacacccgcaucacggaggacgaccugcacaacgaggagaagaucacccagcagauggacccggagcaccggcagcuggccaacgccaucuucaagcucaccuaccagaacaaggucgugaaggugcagcgccccacccccaccgggacggucauggacaucaucagccggaaggaccagcgcggcuccggccagguggggaccuacggccugaacaccuucaccaacauggaggcccagcuggugcggcagauggagggggagggcguccucagcaaggcggaccuggagaacccccaccuccucgagaagaagaucacgcaguggcuggagaccaaggggguggagcgccugaagcggauggccaucuccggcgacgacugcguggucaagccgaucgacgaccgcuucgccaacgcccuccuggcccugaacgacaugggcaaggugcggaaggacaucccccaguggcagcccagcaagggguggcacgacuggcagcagguccccuucugcucccaccacuuccacgagcucaucaugaaggacggccgcaagcuggucgugccgugccggccccaggacgagcugaucgggcgcgcgcgcaucagccagggcgccggguggucccuccgggagaccgccugccugggcaaggccuacgcgcagauguggagccugauguacuuccaccgccgggaccuccgccuggccuccaacgccaucugcagcgccgugcccguccacugggugcccaccagccggacgaccugguccauccacgcccaccaccaguggaugaccaccgaggacaugcugacgguguggaaccgcgucuggaucgaggacaacccguggauggaggacaagacccccgugaccaccugggagaacgugcccuaccucggcaagcgggaggaccaguggugcgggagccugaucggccugacgucccgcgcgaccugggcccagaacauccccaccgccauccagcagguccggagccucaucgggaacgaggaguuccuggacuacaugccguccaugaagcgcuuccggaaggaggaggagagcgagggcgccaucugguga

SEQ ID NO: 9988 - RNA, 9873 nt, Artificial Sequence
  derived and/or modified CDS sequence (opt1) from DENV-3__FJ882573__SS-prME
accagccugugccucaugaugauccugcccgccgcccuggcguuccaccucaccagccgggacggggagccgcggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccugggccagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgccccgugcaagauccccuucagcaccgaggacgggcagggcaaggcccacaacggccgccugaucaccgccaaccccgucgugacgaagaaggaggagcccgugaacaucgaggcggagccgcccuucggggagagcaacaucgucaucggcaucggggacaacgcccugaagaucaacugguacaagaagggcuccagcaucgggaagauguucgaggccaccgcccggggcgcccgccggauggcgauccugggcgacaccgccugggacuucggguccgugggcggggugcucaacagccugggcaagaugguccaccagaucuucggguccgccuacaccgcccuguucagcggcguguccugggugaugaagaucggcaucgggguccuccugacguggaucggccugaacagcaagaacacccccauguccuucagcugcaucgccaucgggaucaucacccucuaccugggcgcgguggugcaggccgacauggggugcgucaucaacuggaagggcaaggagcugaagugcggcuccgggaucuucgugaccaacgaggugcacacguggaccgagcaguacaaguuccaggccgacagccccaagcgccucgccaccgccaucgcgggcgccugggagaacggggucugcggcauccgcuccaccacgcggauggagaaccugcuguggaagcagaucgccaacgagcucaacuacauccugugggagaacaacaucaagcugaccgugguggucggggacaccaccggcgugcucgagcagggcaagcgcacgcugaccccgcagcccauggagcugaaguacagcuggaagaccugggggaaggccaagaucgugaccgcggagacgcagaacuccagcuucaucaucgacggccccaacacccccgagugcccguccgccagccgggccuggaacgucugggagguggaggacuacggguucggcguguucaccaccaacaucuggcucaagcugcgcgaggucuacacccagcugugcgaccaccggcucauguccgccgccgugaaggacgagcgcgcggugcacgccgacaugggcuacuggaucgagagccagaagaacgggagcuggaagcuggagaaggccucccugaucgaggucaagacgugcaccuggcccaagagccacacccucugguccaacggcgugcuggagagcgacaugaucauccccaagucccuggccgggccgaucagccagcacaacuaccggcccggcuaccacacccagacggccgggcccuggcaccucggcaagcuggagcuggacuucaacuacugcgagggcaccaccguggucaucaccgagaacugcgggacgcgcggccccucccuccggaccaccaccgugagcgggaagcugauccacgaguggugcugccgcuccugcacgcugccgccccuccgguacaugggcgaggacgggugcugguacggcauggagauccgccccaucagcgagaaggaggagaacauggugaagucccuggucagcgcgggcuccgggaagguggacaacuucaccaugggcgugcugugccucgccauccuguucgaggaggucaugcgggggaaguucggcaagaagcacaugaucgccgggguguucuucaccuucgugcugcuccugagcggccagaucaccuggcgcgacauggcccacacgcugaucaugaucggcuccaacgccagcgaccggauggggaugggcgucaccuaccucgcgcugaucgccaccuucaagauccagcccuuccuggcccucggguucuuccugcgcaagcugaccucccgggagaaccuccugcugggcgugggccucgccauggcgacgacccugcagcugccggaggacaucgagcagauggccaacgggaucgcccucggccugauggcccugaagcucaucacccaguucgagaccuaccagcuguggacggcccuggugagccugaccugcagcaacaccaucuucacccugacggucgcguggcgcaccgccacccugauccucgccggggugucccugcugcccgucugccagagcuccagcaugcggaagaccgacuggcuccccaugacgguggccgccaugggcgugcccccgcugccccuguucaucuucucccucaaggacacccugaagcgccgcagcuggccccugaacgagggggucauggcggugggccucguguccauccuggccagcucccugcuccggaacgacguccccauggccggcccgcugguggccgggggccugcucaucgccugcuacgugaucaccgggaccagcgcggaccugacggucgagaaggccgccgacgugaccugggaggaggaggccgagcagaccggcgugucccacaaccugaugaucaccgucgacgacgacgggaccaugcgcaucaaggacgacgagacggagaacauccucaccgugcugcugaagaccgcccuccugaucgugagcggcaucuuccccuacuccauccccgcgacccugcucgucuggcacacguggcagaagcagacccagcggagcggcgugcugugggacgugcccuccccgcccgagacccagaaggccgagcuggaggagggggucuaccgcaucaagcagcagggcauccucgggaagacccaggugggcguggggguccagaaggagggcguguuccacacgauguggcacgugacccggggcgccguccugacccacaacgggaagcgccuggagcccaacugggccagcgugaagaaggaccucaucuccuacggcgggggcuggcggcugagcgcgcaguggcagaagggggaggaggugcaggucaucgccguggagcccggcaagaacccgaagaacuuccagaccaugcccggcacguuccagaccaccaccggggagaucggcgccaucgcccuggacuucaagcccgggacguccggcagcccgaucaucaaccgcgagggcaagguggucgggcuguacggcaacgggguggugaccaagaacggcggguacgucagcggcaucgcccagaccaacgcggagcccgacggccccacccccgagcucgaggaggagauguucaagaagcggaaccugacgaucauggaccugcacccgggguccggcaagacccgcaaguaccuccccgccaucgugcgggaggccaucaagcgccggcugcgcacccugauccucgcccccacccggguggucgccgcggagauggaggaggcccugaaggggcugcccauccgcuaccagacgaccgccaccaagagcgagcacaccggccgggagaucguggaccucaugugccacgccacguucaccaugcgccugcuguccccggugcggguccccaacuacaaccucaucaucauggacgaggcccacuucaccgaccccgcgagcaucgccgcccgcggguacaucuccacccgggugggcaugggcgaggccgcggccaucuucaugacggccacgccgcccgggaccgccgacgccuucccccagagcaacgcgcccauccaggacgaggagcgcgacauccccgagcgcuccuggaacagcggcaacgaguggaucaccgacuucgccgggaagacggugugguucguccccuccaucaaggccggcaacgacaucgccaacugccugcggaagaacgggaagaaggugauccagcugagccgcaagaccuucgacaccgaguaccagaagaccaagcucaacgacugggacuucguggucacgaccgacaucuccgagaugggcgccaacuucaaggcggaccgggugaucgacccccgccggugccugaagcccgugauccugaccgacggccccgagcgcgucauccucgccgggccgaugcccgugaccgccgccagcgccgcgcagcggcgcggccggguggggcgcaacccccagaaggagaacgaccaguacaucuucaccggccagccccugaacaacgacgaggaccacgcccacuggacggaggccaagaugcugcucgacaacaucaacaccccggaggggaucauccccgcccuguucgagcccgagcgggagaaguccgcggccaucgacggcgaguaccgccugaagggcgagagccggaagaccuucgucgagcucaugcgccgcggggaccugcccguguggcuggcccacaaggucgccuccgagggcaucaaguacaccgaccgcaaguggugcuucgacgggcagcggaacaaccagauccucgaggagaacauggacguggagaucuggacgaaggagggcgagaagaagaagcugcgcccgcgguggcuggacgcccgcaccuacagcgacccccucgcgcugaaggaguucaaggacuucgccgccggccgcaaguccaucgcccuggaccucgugaccgagaucgggcggguccccagccaccuggcccaccgcacccggaacgcgcuggacaaccucgugaugcugcacacguccgagcacggcgggcgcgccuaccggcacgccguggaggagcugccggagaccauggagacccuccugcugcucggccugaugauccugcucaccgggggcgccaugcuguuccugaucagcggcaaggggaucggcaagacgagcaucgggcucaucugcgucaucgccuccagcggcaugcuguggauggcggaggugccccugcaguggaucgccuccgccaucgugcucgaguucuucaugaugguccugcugauccccgagcccgagaagcagcgcaccccgcaggacaaccagcucgccuacguggugaucgggauccugacccuggccgcgaugaucgccgccaacgagaugggccuccuggagaccacgaagcgggaccugggcaugagcaaggagcccggggucgugucccccaccagcuaccucgacguggaccugcaccccgccuccgcguggacccuguacgccgucgccaccacggugaucaccccgaugcuccgccacaccaucgagaacagcaccgccaacgugucccuggccgcgaucgccaaccaggccgucgugcugaugggccucgacaagggguggcccaucagcaagauggaccugggcgugccccugcucgcccuggggugcuacucccaggucaacccccugacgcucaccgccgcggugcugcugcucaucacccacuacgccaucaucggcccgggccugcaggccaaggccacccgggaggcccagaagcgcacggcggccgggaucaugaagaaccccaccguggacggcaucaugaccaucgaccuggaccccgucaucuacgacagcaaguucgagaagcagcucggccaggugaugcugcuggugcucugcgccguccagcugcugcucaugcggaccuccugggcccugugcgaggcgcugacgcucgccaccggccccaucaccacccugugggagggcagcccggggaaguucuggaacacgaccaucgccguguccauggccaacaucuuccgcggcagcuaccuggccggggcgggccucgccuucuccaucaugaaguccguggggaccggcaagcggggcaccgggucccagggcgagacccugggggagaaguggaagaagaagcugaaccagcucagccgcaaggaguucgaccuguacaagaaguccggcaucacggaggucgaccggaccgaggccaaggaggggcugaagcgcggcgagaucacccaccacgccgugucccggggcagcgccaagcuccagugguucguggagcgcaacauggucgugcccgaggggcgggugaucgaccugggcugcgggcgcggcgggugguccuacuacugcgcgggccugaagaaggucaccgaggugcggggcuacacgaagggcgggcccgggcacgaggagcccgugccgaugagcaccuacggcuggaacaucgucaagcucauguccgggaaggacguguucuaccugccgcccgagaagugcgacacccugcugugcgacaucggcgagagcucccccagcccgaccguggaggagucccgcacgauccgcguccucaagaugguggagcccuggcugaagaacaaccaguucugcaucaaggugcugaaccccuacaugcccaccgucaucgagcaccucgagcggcugcagcgcaagcacggcgggaugcuggugcggaacccgcucagccgcaacuccacccacgagauguacuggaucagcaacggcaccgggaacaucguguccagcgucaacauggugucccggcugcugcucaaccgcuucacgaugacccaccggcgccccaccaucgagaaggacguggaccugggcgccggcacccggcacgucaacgccgagcccgagacgccgaacauggacgugaucggggagcgcgucaagcggaucaaggaggagcacaacagcaccuggcacuacgacgacgagaaccccuacaagaccugggccuaccacggcuccuacgaggugaaggccaccgggagcgcguccagcaugaucaacggcguggucaagcugcucacgaagcccugggacguggugcccauggucacccagauggccaugaccgacaccacgccguucgggcagcagcgcguguucaaggagaagguggacacccggacgccccggcccaugcccggcacccggaaggucauggagaucacggccgaguggcuguggcgcacccugggccggaacaagcgcccgcggcucugcacccgcgaggaguucaccaagaaggugcgcacgaacgccgcgaugggggccguguucaccgaggagaaccagugggacagcgccaaggccgccgucgaggacgaggaguucuggaagcugguggaccgggagcgcgagcugcacaagcucggcaagugcggguccugcguguacaacaugaugggcaagcgggagaagaagcugggggaguucggcaaggcgaagggcagccgcgccaucugguacauguggcugggggcccgguaccucgaguucgaggcccugggcuuccugaacgaggaccacugguucucccgcgagaacagcuacuccggggucgagggcgaggggcuccacaagcugggcuacauccugcgggacaucagcaagauccccggcggggccauguacgcggacgacaccgccggcugggacacccgcaucacggaggacgaccuccacaacgaggagaagaucauccagcagauggaccccgagcaccggcagcuggccaacgccaucuucaagcugaccuaccagaacaagguggugaagguccagcgccccaccccgaccgggaccgugauggacaucaucucccggaaggaccagcgcggcagcggccagguggggacguacggccucaacaccuucaccaacauggaggcccagcugguccggcagauggagggggagggcgugcugaccaaggcggaccucgagaacccccaccuccuggagaagaagaucacgcaguggcucgaggccaaggggguggagcgccugaagcggauggccaucuccggcgacgacugcgucgugaagcccaucgacgaccgcuucgccaacgcccugcucgcgcugaacgacaugggcaaggugcggaaggacaucccccaguggcagccgagcaagggguggcacgacuggcagcagguccccuucugcucccaccacuuccacgagcugaucaugaaggacggccgcaagcucguggugcccugccggccccaggacgagcugaucgggcgcgcccggaucagccagggcgccggguggucccugcgcgagaccgccugccucggcaaggcguacgcccagauguggagccugauguacuuccaccgccgggaccugcgccucgccuccaacgccaucugcagcgccgucccggugcacugggugcccaccucccggaccacguggagcauccacgcgcaccaccaguggaugaccaccgaggacaugcugaccgucuggaaccgcguguggaucgaggagaaccccuggauggaggacaagacgcccgugaccaccugggagaacgucccguaccugggcaagcgggaggaccaguggugcgggucccucaucggccugaccagccgcgccacgugggcccagaacauccccaccgccauccagcagguccggagccugaucgggaacgaggaguuccucgacuacaugcccuccaugaagcgcuuccggaaggaggaggagagcgagggcgccaucugguga

SEQ ID NO: 9989 - RNA, 9873 nt, Artificial Sequence
  derived and/or modified CDS sequence (opt1) from DENV-3__FJ898440__SS-prME
accagccucugccucaugaugauccuccccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaucaccgaggcgauccugcccgaguacggcacccuggggcucgagugcuccccgcgcaccggccuggacuucaacgagauggugcugcucaccaugaagaacaaggccuggauggugcaccggcagugguucuucgaccugccccugcccuggacgagcggcgccaccaccgagacccccaucuggaaccgcaaggagcuccuggucacguucaagaacgcccacgccaagaagcaggagguggugguccuggggucccaggagggcgcgaugcacaccgcccucaccggggccaccgagauccagaacagcggcgggacguccaucuucgccggccaccugaagugccggcugaagauggacaagcucgagcugaagggcaugagcuacgccaugugcaccaacaccuucgugcugaagaaggagguguccgagacccagcacgggacgauccucaucaaggucgaguacaagggcgaggacgcgccgugcaagauccccuucagcaccgaggacgggcagggcaaggcccacaacggccgccugaucaccgccaaccccguggugaccaagaaggaggagcccgucaacaucgaggccgagccgcccuucggggagagcaacaucgugaucggcaucggggacaacgcgcugaagaucaacugguacaagaagggcuccagcaucgggaagauguucgaggccacggcccggggcgcccgccggauggccauccugggcgacaccgcgugggacuucggguccgugggcgggguccucaacagccugggcaagauggugcaccagaucuucggguccgccuacaccgcccuguucagcggcguguccugggucaugaagaucggcaucggggugcuccugaccuggaucggccugaacagcaagaacacguccaugagcuucuccugcaucgccaucgggaucaucacccucuaccugggcgccgugguccaggcggacaccgggugcgugaucaacuggaagggcaaggagcugaagugcggcagcgggaucuucgugaccaacgagguccacacguggaccgagcaguacaaguuccaggccgacucccccaagcgccucgccaccgccaucgccggcgcgugggagaacggggugugcggcauccgcagcaccacgcggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagacgugggggaaggccaagaucgucaccgccgagacccagaacagcuccuucaucaucgacggccccaacacccccgagugccccagcgcgucccgggccuggaacgugugggagguggaggacuacggguucggcgucuucacgaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcaccuggccgaagucccacacgcucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcaccacggucgugaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgcgauccuguucgaggaggugaugcgggggaaguucggcaagaagcacaugaucgccgggguguucuucacguucguccugcuccuguccggccagaucaccuggcgcgacauggcccacacccugaucaugaucggcagcaacgccuccgaccggauggggaugggcgugaccuaccucgcccugaucgcgacguucaagauccagcccuuccuggcccucggguucuuccugcgcaagcugaccagccgggagaaccuccugcugggcgugggccucgccauggccaccacccugcagcugcccgaggacaucgagcagauggcgaacgggaucgcccucggccugauggcccugaagcucaucacgcaguucgagaccuaccagcuguggaccgcccugaucagccugaccugcuccaacacgaucuucacccugaccgucgccuggcgcaccgcgacgcugauccucgccggggugagccugcugccggucugccaguccagcuccaugcggaagaccgacuggcuccccaugaccguggccgccaugggcgugcagccccugccccuguucaucuucagccucaaggacacccugaagcgccgcuccuggccgcugaacgagggggucauggccgugggccucgugagcauccuggcguccagccugcuccggaacgacguccccauggccggcccccugguggccgggggccugcucaucgccugcuacgugaucacggggaccuccgccgaccugaccgucgagaaggcggccgacgugaccugggaggaggaggccgagcagacgggcgugagccacaaccugaugaucaccgucgacgacgacgggaccaugcgcaucaaggacgacgagaccgagaacauccucaccgugcugcugaagacggcccuccugaucguguccggcaucuuccccuacagcaucccggccacccugcucgucuggcacaccuggcagaagcagacccagcgguccggcgugcugugggacgugcccuccccgcccgagacgcagaaggcggagcuggaggagggggucuaccgcaucaagcagcagggcaucuucgggaagacccaggugggcguggggguccagaaggagggcguguuccacaccauguggcacgugacccggggcgccguccucacguacaacgggaagcgccuggagccgaacugggccuccgugaagaaggaccugaucagcuacggcgggggcuggcggcucuccgcccaguggcagaagggggaggaggugcaggucaucgcgguggagcccggcaagaaccccaagaacuuccagaccaugcccggcaccuuccagaccacgaccggggagaucggcgccaucgcccuggacuucaagccggggaccagcggcagccccaucaucaaccgcgagggcaagguggucgggcuguacggcaacgggguggugaccaagaacggcggguacgucuccggcaucgcccagacgaacgccgagcccgacggcccgacccccgagcuggaggaggagauguucaagaagcggaaccucaccaucauggaccugcaccccgggagcggcaagacccgcaaguaccugcccgcgaucgugcgggaggccaucaagcgccggcuccgcacgcugauccuggccccgacccggguggucgccgccgagauggaggaggcgcucaaggggcugcccauccgcuaccagaccaccgccacgaaguccgagcacaccggccgggagaucguggaccugaugugccacgccaccuucaccaugcgccuccugagccccgugcggguccccaacuacaaccugaucaucauggacgaggcccacuucacggacccggccuccaucgcggcccgcggguacaucagcacccgggugggcaugggcgaggccgccgcgaucuucaugaccgccacgccgcccgggacggccgacgccuucccccaguccaacgccccgauccaggacgaggagcgcgacauccccgagcgcagcuggaacuccggcaacgaguggaucaccgacuucgcggggaagaccgugugguucguccccagcaucaaggccggcaacgacaucgccaacugccuccggaagaacgggaagaaggugauccagcugucccgcaagaccuucgacacggaguaccagaagaccaagcugaacgacugggacuucguggucaccaccgacaucagcgagaugggcgccaacuucaaggccgaccgggugaucgacccccgccggugccucaagccggugauccugacggacggccccgagcgcgucauccuggcggggcccaugcccgugaccgccgccuccgccgcccagcggcgcggccggguggggcgcaacccgcagaaggagaacgaccaguacaucuucaccggccagccccucaacaacgacgaggaccacgcgcacuggaccgaggccaagaugcugcuggacaacaucaacacccccgaggggaucauccccgcccucuucgagccggagcgggagaaguccgccgcgaucgacggcgaguaccgccugaagggcgagucccggaagacguucgucgagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacuccgacccccuggcccucaaggaguucaaggacuucgcggccggccgcaagagcaucgcccuggaccuggugacggagaucgggcgggucccgucccaccucgcccaccgcacccggaacgcccuggacaaccuggugaugcuccacaccagcgagcacggcgggcgcgcguaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgucaucgccagcuccggcaugcucuggauggccgagaucccccugcaguggaucgcgagcgccaucgugcuggaguucuucaugauggugcuccugaucccggagcccgagaagcagcgcacgccccaggacaaccagcuggccuacgucgugaucgggauccucacgcuggccgccaucaucgcggccaacgagaugggccugcucgagaccaccaagaaggaccugggcauguccaaggagcccgggguggucagcccgaccuccuaccuggacguggaccuccaccccgccagcgccuggacgcuguacgcgguggccaccaccgucaucacccccaugcugcggcacacgaucgagaacuccaccgccaacgugagccucgccgccaucgcgaaccaggccgugguccugaugggccuggacaagggguggcccaucuccaagauggaccucggcgugccgcugcuggcccucgggugcuacagccaggugaacccccugacccugaccgccgccguccuccugcugaucacgcacuacgcgaucaucggccccggccuccaggccaaggccacccgcgaggcccagaagcggaccgccgcggggaucaugaagaaccccaccguggacggcaucaugacgaucgaccuggacccggugaucuacgacuccaaguucgagaagcagcuggggcaggucaugcuccuggugcugugcgccgugcagcuccugcugaugcgcaccagcugggcccucugcgaggcccugacccuggcgaccggccccaucacgacccucugggagggcucccccgggaaguucuggaacaccaccaucgccgucagcauggccaacaucuuccggggcuccuaccuggccggggccggccuggcguucagcaucaugaaguccguggggacgggcaagcgcggcaccgggagccagggcgagacccucggggagaaguggaagaagaagcugaaccagcugagccggaaggaguucgaccucuacaagaaguccggcaucaccgagguggaccgcaccgaggccaaggaggggcugaagcggggcgagaucacgcaccacgccgucagccgcggcuccgccaagcugcagugguucguggagcggaacauggugauccccgaggggcgcgucaucgaccucggcugcgggcggggcggguggagcuacuacugcgccggccugaagaaggugaccgaggugcgcggcuacaccaagggcgggccggggcacgaggagcccguccccauguccaccuacggcuggaacaucgugaagcugaugagcgggaaggacguguucuaccucccgcccgagaagugcgacacgcugcugugcgacaucggcgaguccagccccucccccaccgucgaggagagccggaccauccgcgugcugaagaugguggagcccuggcucaagaacaaccaguucugcaucaagguccugaaccccuacaugcccaccgugaucgagcaccuggagcgccuccagcggaagcacggcgggaugcuggugcgcaacccccugucccggaacagcacgcacgagauguacuggaucuccaacggcaccgggaacaucgucgcgagcgugaacauggugucccgccuccugcugaaccgguucaccaugacccaccgccggcccacgaucgagaaggacgucgaccucggcgccggcacccgccacgugaacgccgagccggagacccccaacauggacgugaucggggagcggaucaagcgcaucaaggaggagcacaacagcaccuggcacuacgacgacgagaaccccuacaagacgugggccuaccacggcuccuacgaggucaaggccaccgggagcgcguccagcaugaucaacggcguggucaagcugcugaccaagccgugggacguggugcccauggucacccagauggccaugacggacaccacccccuucgggcagcagcggguguucaaggagaagguggacacccgcacgccccggagcaugccgggcacccgccgggucaugggcaucaccgccgaguggcucuggcgcacccuggggcggaacaagaagccccgccugugcacgcgggaggaguucaccaagaaggugcgcaccaacgccgcgaugggcgccguguucaccgaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgcggacgacacggccgggugggacacccggaucaccgaggacgaccugcacaacgaggagaagaucacccagcagaugaaccccgagcaccgccagcucgccaacgccaucuucaagcugacguaccagaacaagguggugaagguccagcggccgacccccaccggcaccgugauggacaucaucagccgcaaggaccagcggggcuccggccaggugggcaccuacgggcugaacacguucaccaacauggaggcccagcucauccgccagauggagggcgaggggguccugagcaaggcggaccuggagaacccccaccuccccgagaagaagaucacccaguggcuggagaccaagggcguggagcggcugaagcgcauggccaucuccggcgacgacugcguggucaagccgaucgacgaccgguucgccaacgcccuccuggcccugaacgacauggggaaggugcgcaaggacaucccccaguggcagcccagcaagggcuggcacgacuggcagcagguccccuucugcucccaccacuuccacgagcucaucaugaaggacgggcggaagcuggucgugccgugccgcccccaggacgagcugaucggccgggcgcgcaucagccagggggccggcuggucccuccgggagacggccugccugggcaaggccuacgcgcagauguggagccugauguacuuccaccgccgcgaccuccggcuggccuccaacgccaucugcagcgccgugcccguccacugggugcccaccucccgcaccaccuggagcauccacgcccaccaccaguggaugacgaccgaggacaugcugaccguguggaaccgggucuggaucgaggacaacccguggauggaggacaagacccccgugacgaccugggagaacgugcccuaccucgggaagcgcgaggaccaguggugcggcagccugaucgggcugaccucccgggcgaccugggcccagaacauccccacggccauccagcagguccgcagccucaucggcaacgaggaguuccuggacuacaugccguccaugaagcgguuccgcaaggaggaggagagcgagggggccaucugguga

SEQ ID NO: 9990 - RNA, 9873 nt, Artificial Sequence
  derived and/or modified CDS sequence (opt1) from DENV-3__FJ898441__SS-prME
accagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaagaugguccaguacgagaaccucaaguacaccgugaucaucacggugcacaccggggaccagcaccaggucggcaacgagacccagggggugaccgccgagaucacgccccaggccagcaucaccgaggcgauccugcccgaguacggcacccuggggcucgagugcuccccgcgcaccggccuggacuucaacgagaugauccugcucaccaugaagaacaaggccuggaugguccaccggcagugguucuucgaccugccccugcccuggacgagcggcgccaccaccgagacccccacguggaaccgcaaggagcuccuggugaccuucaagaacgcccacgccaagaagcaggagguggucgugcuggggucccaggagggcgcgaugcacaccgcccucaccggggccacggagauccagaacagcggcgggaccaccaucuucgccggccaccugaagugccggcugaagauggacaagcucgagcugaagggcauguccuacgccaugugcaccaacacguucgugcugaagaaggaggucagcgagacccagcacgggaccauccucaucaagguggaguacaagggcgaggacgcgccgugcaagauccccuucuccaccgaggacgggcagggcaaggcccacaacggccgccugaucacggccaaccccguggucaccaagaaggaggagcccgugaacaucgaggccgagccgcccuucggggagagcaacaucgugaucggcaucggggacaacgcgcugaagaucaacugguacaagaagggcagcuccaucgggaagauguucgaggccaccgcccggggcgcccgccggauggccauccugggcgacaccgcgugggacuucgggagcgucggcggggugcucaacucccugggcaagauggugcaccaggucuucgggagcgccuacacggcccuguucuccggcgugagcugggugaugaagaucggcaucgggguccuccugaccuggaucggccugaacuccaagaacaccagcauguccuucagcugcaucgccaucgggaucaucacccucuaccugggcgccguggugcaggcggacacggggugcgucaucaacuggaagggcaaggagcugaagugcggcuccgggaucuucgugaccaacgaggugcacaccuggaccgagcaguacaaguuccaggccgacagccccaagcgccucgccacggccaucgccggcgcgugggagaacggggucugcggcauccgcuccaccacccggauggagaaccugcuguggaagcagaucgccaacgagcucaacuacauccugugggagaacaacaucaagcugaccgugguggucggggacaucaucggcgugcucgagcagggcaagcgcacgcugaccccccagccgauggagcugaaguacagcuggaagaccugggggaaggccaagaucgugaccgccgagacgcagaacuccagcuucaucaucgacggccccaacacccccgagugccccuccgcgagccgggccuggaacgucugggagguggaggacuacggguucggcguguucaccaccaacaucuggcucaagcugcgcgaggucuacacccagcugugcgaccaccggcucauguccgccgccgugaaggacgagcgcgccgugcacgcggacaugggcuacuggaucgagagccagaagaacgggagcuggaagcuggagaaggccucccugaucgaggucaagacgugcaccuggccgaagagccacacccucugguccaacggcgugcuggagagcgacaugaucauccccaagucccuggccgggcccaucagccagcacaacuaccggccgggcuaccacacccagacggccgggcccuggcaccucggcaagcuggagcuggacuucaacuacugcgagggcaccaccguggucaucaccgagaacugcgggacgcgcggccccucccuccggaccaccaccgugagcgggaagcugauccacgaguggugcugccgcuccugcacgcugcccccgcuccgguacaugggcgaggacgggugcugguacggcauggagauccgccccaucagcgagaaggaggagaacauggugaagucccuggucagcgccggcuccgggaagguggacaacuucaccaugggcgugcugugccucgcgauccuguucgaggaggucaugcgggggaaguucggcaagaagcacaugaucguggggguguucuucaccuucguccugcuccugagcggccagaucaccuggcgcgacauggcccacacgcugaucaugaucggcuccaacgccagcgaccggauggggaugggcgugaccuaccucgcccugaucgccaccuucaagauccagcccuuccuggcgcucggguucuuccugcgcaagcugaccucccgggagaaccuccugcugggcgugggccucgccauggccacgacccugcagcugcccgccgacaucgagcagauggcgaacgggaucgcccucggccugauggcccugaagcucaucacccaguucgagaccuaccagcuguggacggcccugaucagccucaccugcagcaacaccaucuucacccugacggucgccuggcgcaccgcgacccugauccucgccggggugucccugcugccggucugccagagcuccagcaugcggaagaccgacuggcuccccaugacgguggccgccaugggcgugcagccccugccccuguucaucuucucccucaaggacacccugaagcgccgcagcuggccgcugaacgagggggucauggccgugggccucguguccauccuggcgagcucccugcuccggaacgacguccccauggccggcccccugguggccgggggccugcucaucgccugcuacgugaucaccgggaccagcgccgaccugacggucgagaaggcggccgacgugaccugggaggaggaggccgagcagaccggcgugucccacaaccugaugaucaccgucgacgacgacgggaccaugcgcaucaaggacgacgagacggagaacauccucaccgugcugcugaagaccgcccuccugaucgugagcggcaucuuccccuacuccaucccggccacccugcucgucuggcacacguggcagaagcagacccagcggagcggcgugcugugggacgugcccuccccccccgagacccagaaggcggagcuggaggagggggucuaccgcaucaagcagcagggcaucuucgggaagacccaggugggcguggggguccagaaggagggcguguuccacacgauguggcacgugacccggggcgccguccucaccuacaacgggaagcgccuggagccgaacugggccagcgugaagaaggaccugaucuccuacggcgggggcuggcggcucagcgcccaguggcagaagggggaggaggugcaggucaucgcgguggagcccggcaagaaccccaagaacuuccagaccaugcccggcacguuccagaccaccaccggggagaucggcgccaucgcccuggacuucaagccggggacguccggcagccccaucaucaaccgcgagggcaagguggucgggcuguacggcaacgggguggugaccaagaacggcggguacgucagcggcaucgcccagaccaacgccgagcccgacggcccgacccccgagcuggaggaggagauguucaagaagcggaaccucacgaucauggaccugcaccccggguccggcaagacccgcaaguaccugcccgcgaucgugcgggaggccaucaagcgccggcuccgcacccugauccuggccccgacccggguggucgccgccgagauggaggaggcgcucaaggggcugcccauccgcuaccagacgaccgccaccaagagcgagcacaccggccgggagaucguggaccugaugugccacgccacguucaccaugcgccuccugucccccgugcggguccccaacuacaaccugaucaucauggacgaggcccacuucaccgacccggccagcaucgcggcccgcggguacaucuccacccgggugggcaugggcgaggccgccgcgaucuucaugacggccaccccccccgggaccgccgacgccuucccccagagcaacgccccgauccaggacgaggagcgcgacauccccgagcgcuccuggaacagcggcaacgaguggaucaccgacuucgcggggaagacggugugguucguccccuccaucaaggccggcaacgacaucgccaacugccuccggaagaacgggaagaaggugauccagcugagccgcaagaccuucgacaccgaguaccagaagaccaagcugaacgacugggacuucguggucacgaccgacaucuccgagaugggcgccaacuucaaggccgaccgggugaucgacccccgccggugccucaagccggugauccugaccgacggccccgagcgcgucauccuggcggggcccaugcccgugaccgccgccagcgccgcccagcggcgcggccggguggggcgcaacccgcagaaggagaacgaccaguacaucuucaccggccagccccucaacaacgacgaggaccacgcgcacuggacggaggccaagaugcugcuggacaacaucaacacccccgaggggaucauccccgcccucuucgagccggagcgggagaaguccgccgcgaucgacggcgaguaccgccugaagggcgagagccggaagaccuucgucgagcugaugcgccggggggaccuccccguguggcuggcccacaaggucgccuccgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacagcgacccccuggcccucaaggaguucaaggacuucgcggccggccgcaaguccaucgcccuggaccuggugaccgagaucgggcgggucccgagccaccucgcccaccgcacccggaacgcccuggacaaccuggugaugcuccacacguccgagcacggcgggcgcgcguaccggcacgccguggaggagcugcccgagaccauggagacccugcuccugcugggccucaugauccugcugaccgggggcgccaugcucuuccugaucagcggcaaggggaucggcaagacgagcaucgggcugaucugcgucaucgccuccagcggcaugcucuggauggccgagaucccccugcaguggaucgcguccgccaucgugcuggaguucuucaugauggugcuccugaucccggagcccgagaagcagcgcaccccccaggacaaccagcuggccuacgucgugaucgggauccucacccuggccgccaucaucgcggccaacgagaugggccugcucgagaccacgaagaaggaccugggcaugagcaaggagcccgggguggucuccagcaccuccuaccuggacguggaccuccacccggccagcgccuggacccuguacgcgguggccaccacggucaucacccccaugcugcggcacaccaucgagaacuccaccgccaacgugagccucgccgccaucgcgaaccaggccgugguccugaugggccuggacaagggguggcccaucuccaagauggaccucggcgugccccugcuggcccucgggugcuacagccaggugaacccgcugacgcugaccgccgccguccuccugcugaucacccacuacgcgaucaucggccccggccuccaggccaaggccacccgcgaggcccagaagcggacggccgcggggaucaugaagaaccccaccguggacggcaucaugaccaucgaccuggaccccgugaucuacgacuccaaguucgagaagcagcuggggcaggucaugcuccuggugcugugcgccgugcagcuccugcugaugcgcaccagcugggcccucugcgaggcccugacgcuggcgaccggcccgaucaccacccucugggagggcucccccgggaaguucuggaacacgaccaucgccgucagcauggccaacaucuuccggggcuccuaccuggccggggccggccuggcguucagcaucaugaaguccguggggaccggcaagcgcggcaccgggagccagggcgagacccucggggagaaguggaagaagaagcugaaccagcugagccggaaggaguucgaccucuacaagaaguccggcaucacggagguggaccgcaccgaggccaaggaggggcugaagcggggcgagaucacccaccacgccgucagccgcggcuccgccaagcugcagugguucguggagcggaacauggugauccccgaggggcgcgucaucgaccucggcugcgggcggggcggguggagcuacuacugcgccggccugaagaaggugaccgaggugcgcggcuacacgaaggggggccccgggcacgaggagccgguccccauguccaccuacggcuggaacaucgugaagcugaugaccgggaaggacguguucuaccucccccccgagaagugcgacacccugcugugcgacaucggcgagagcuccccgagccccacggucgaggagucccggaccauccgcgugcugaagaugguggagcccuggcucaagaacaaccaguucugcaucaagguccugaaccccuacaugccgaccgugaucgagcaccuggagcgccuccagcggaagcacggcgggaugcuggugcgcaacccccugagccggaacuccacccacgagauguacuggaucagcaacggcacggggaacaucgucgcguccgugaacauggugagccgccuccugcugaaccgguucaccaugacccaccgccggcccaccaucgagcgcgacgucgaccucggcgccggcacgcggcacgugaacgccgagcccgagaccccgaacauggacgugaucggggagcgcaucaagcggaucaaggaggagcacaacuccaccuggcacuacgacgacgagaaccccuacaagaccugggccuaccacggcagcuacgaggucaaggccacgggguccgcgagcuccaugaucaacggcguggucaagcugcugaccaagcccugggacguggugccgauggucacccagauggccaugaccgacacgacccccuucgggcagcagcgcguguucaaggagaagguggacacccggaccccccgcagcaugcccggcacgcggaaggucaugggcaucaccgccgaguggcucuggcgcacccuggggcggaacaagaagccgcgccugugcacccgggaggaguucacgaagaaggugcgcaccaacgccgcgaugggcgccguguucaccgaggagaaccagugggacagcgccaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggcgaaggggagccgggccaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaccauccccgggggcgccauguacgcggacgacacggccgggugggacacccggaucaccgaggacgaccugcacaacgaggagaagaucacccagcagauggaccccgagcaccgccagcucgccaacgccaucuucaagcugaccuaccagaacaagguggugaagguccagcggcccacgccgaccggcaccgugauggacaucaucucccgcaaggaccagcggggcagcgggcaggugggcaccuacgggcugaacacguucaccaacauggaggcccagcucauccgccagauggagggcgaggggguccuguccaaggcggaccuggagaacccccaccuccccgagaagaagaucacccaguggcuggagaccaagggcguggagcggcugaagcgcauggccaucagcggcgacgacugcguggucaagcccaucgacgaccgguucgccaacgcccuccuggcccugaacgacauggggaaggugcgcaaggacaucccgcaguggcagcccuccaagggcuggcacgacuggcagcaggugcccuucugcagccaccacuuccacgagcucaucaugaaggacgggcggaagcuggucgugcccugccgcccgcaggacgagcugaucggccgggcgcgcaucucccagggggccggcuggagccuccgggagacggccugccugggcaaggccuacgcgcagauguggucccugauguacuuccaccgccgcgaccuccggcuggccagcaacgccaucugcuccgccgugcccguccacugggugcccaccagccgcaccaccugguccauccacgcccaccaccaguggaugacgaccgaggacaugcugaccguguggaaccgggucuggaucgaggacaaccccuggauggaggacaagaccccggugacgaccugggagaacgugcccuaccucgggaagcgcgaggaccaguggugcggcagccugaucgggcugaccagccgggcgaccugggcccagaacauccccacggccauccagcagguccgcucccucaucggcaacgaggaguuccuggacuacaugcccagcaugaagcgguuccgcaaggaggaggaguccgagggggccaucugguga

SEQ ID NO: 9991 - RNA, 9873 nt, Artificial Sequence
  derived and/or modified CDS sequence (opt1) from DENV-3__FJ898442__SS-prME
accucccucugccucaugaugauccuccccgccgcccucgcguuccaccucaccucccgggacggggagccccggaugaucguggggaagaacgagcgcggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagaccugggcccugcgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaagaugguccaguacgagaaccucaaguacaccgugaucaucacggugcacaccggggaccagcaccaggucggcaacgagacccagggggugaccgccgagaucacgccccaggccagcaucaccgaggcgauccugcccgaguacggcacccuggggcucgagugcuccccgcgcaccggccuggacuucaacgagaugauccugcucaccaugaagaacaaggccuggaugguccaccggcagugguucuucgaccugccccugcccuggacgagcggcgccaccaccgagacccccacguggaaccgcaaggagcuccuggugaccuucaagaacgcccacgccaagaagcaggagguggucgugcuggggucccaggagggcgcgaugcacaccgcccucaccggggccacggagauccagaacagcggcgggaccaccaucuucgccggccaccugaagugccggcugaagauggacaagcucgagcugaagggcauguccuacgccaugugcaccaacacguucgugcugaagaaggaggucagcgagacccagcacgggaccauccucaucaagguggaguacaagggcgaggacgcgccgugcaagauccccuucuccaccgaggacgggcagggcaaggcccacaacggccgccugaucacggccaaccccguggucaccaagaaggaggagcccgugaacaucgaggccgagccgcccuucggggagagcaacaucgugaucggcaucggggacaacgcgcugaagaucaacugguacaagaagggcagcuccaucgggaagauguucgaggccaccgcccggggcgcccgccggauggccauccugggcgacaccgcgugggacuucgggagcgucggcggggugcucaacucccugggcaagauggugcaccaggucuucgggagcgccuacacggcccuguucuccggcgugagcugggugaugaagaucggcaucgggguccuccugaccuggaucggccugaacuccaagaacaccagcauguccuucagcugcaucgccaucgggaucaucacccucuaccugggcgccguggugcaggcggacacggggugcgucaucaacuggaagggcaaggagcugaagugcggcuccgggaucuucgugaccaacgaggugcacaccuggaccgagcaguacaaguuccaggccgacagccccaagcgccucgccacggccaucgccggcgcgugggagaacggggucugcggcauccgcuccaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacagcuggaagaccugggggaaggccaagaucgugaccgccgagacgcagaacuccagcuucaucaucgacggccccaacacccccgagugccccuccgcgagccgggccuggaacgucugggagguggaggacuacggguucggcguguucaccaccaacaucuggcucaagcugcgcgaggucuacacccagcugugcgaccaccggcucauguccgccgccgugaaggacgagcgcgccgugcacgcggacaugggcuacuggaucgagagccagaagaacgggagcuggaagcuggagaaggccucccugaucgaggucaagacgugcaccuggcccaagagccacacccucugguccaacggcgugcuggagagcgacaugaucaucccccggucccuggccgggcccaucagccagcacaacuaccgcccgggcuaccacacccagacggccgggcccuggcaccucggcaagcuggagcuggacuucaacuacugcgagggcaccaccguggucaucaccgagaacugcgggacgcggggccccucccuccgcaccaccaccgugagcgggaagcugauccacgaguggugcugccgguccugcacgcugcccccgcuccgcuacaugggcgaggacgggugcugguacggcauggagauccggcccaucagcgagaaggaggagaacauggugaagucccuggucagcgccggcuccgggaagguggacaacuucaccaugggcgugcugugccucgcgauccuguucgaggaggucaugcgcgggaaguucggcaagaagcacaugaucgccgggguguucuucaccuucgugcugcuccugagcggccagaucaccuggcgggacauggcccacacgcugaucaugaucggcuccaacgccagcgaccgcauggggaugggcgucaccuaccucgcccugaucgcgaccuucaagauccagcccuuccuggcccucggguucuuccugcggaagcugaccucccgcgagaaccuccugcugggcgugggccucgccauggccacgacccugcagcugcccgcggacaucgagcagauggccaacgggaucgcccucggccugauggcccugaagcucaucacccaguucgagaccuaccagcuguggacggcccugaucagccugaccugcagcaacaccaucuucacccugacgguggcguggcggaccgccacccugauccucgccggggucucccugcugccggugugccagagcuccagcaugcgcaagaccgacuggcuccccaugacggucgccgccaugggcgugcagccccugccccuguucaucuucucccucaaggacacccugaagcgccggagcuggccgcugaacgagggggugauggcggucggccucguguccauccuggccagcucccugcuccgcaacgacgugcccauggccggcccccuggucgccgggggccugcucaucgccugcuacgugaucaccgggaccagcgcggaccugacgguggagaaggccgccgacgucaccugggaggaggaggccgagcagaccggcgugucccacaaccugaugaucaccguggacgacgacgggaccaugcggaucaaggacgacgagacggagaacauccucaccguccugcugaagaccgcccuccugaucgugagcggcaucuuccccuacuccaucccggcgacccugcucguguggcacacguggcagaagcagacccagcgcagcggcguccugugggacgugcccagcccgcccgagacccagaaggccgagcuggaggaggggguguaccggaucaagcagcagggcaucuucgggaagacccaggucggcgugggggugcagaaggagggcgucuuccacacgauguggcacgugacccgcggcgccgugcucaccuacaacgggaagcggcuggagccgaacugggccagcgucaagaaggaccugaucuccuacggcgggggcuggcgccucagcgcgcaguggcagaagggggaggagguccaggugaucgccgucgagcccggcaagaaccccaagaacuuccagaccaugcccggcacguuccagaccaccaccggggagaucggcgccaucgcccuggacuucaagccggggacguccggcagccccaucaucaaccgggagggcaaggugguggggcuguacggcaacggggucgugaccaagaacggcggguacgugagcggcaucgcccagaccaacgcggagcccgacggcccgacccccgagcuggaggaggagauguucaagaagcgcaaccucacgaucauggaccugcaccccggguccggcaagacccggaaguaccugcccgccaucguccgcgaggccaucaagcggcgccuccggacccugauccuggccccgacccgcgugguggccgcggagauggaggaggcccucaaggggcugcccauccgguaccagacgaccgccaccaagagcgagcacaccggccgcgagaucgucgaccugaugugccacgccacguucaccaugcggcuccugucccccgugcgcgugcccaacuacaaccugaucaucauggacgaggcccacuucaccgacccggcgagcaucgccgcccggggguacaucuccacccgcgucggcaugggcgaggccgcggccaucuucaugacggccacgccgcccgggaccgccgacgccuucccccagagcaacgcgccgauccaggacgaggagcgcgacauccccgagcgguccuggaacagcggcaacgaguggaucaccgacuucgccgggaagacggugugguucgugcccuccaucaaggccggcaacgacaucgccaacugccuccgcaagaacgggaagaaggucauccagcugagccggaagaccuucgacaccgaguaccagaagaccaagcugaacgacugggacuucguggugacgaccgacaucuccgagaugggcgccaacuucaaggcggaccgcgucaucgacccccggcgcugccucaagccggugauccugaccgacggccccgagcgggugauccuggccgggcccaugcccgucaccgccgccagcgccgcgcagcgccggggccgcguggggcggaacccgcagaaggagaacgaccaguacaucuucaccggccagccccucaacaacgacgaggaccacgcccacuggacggaggccaagaugcugcuggacaacaucaacacccccgaggggaucauccccgcccucuucgagccggagcgcgagaaguccgcggccaucgacggcgaguaccggcugaagggcgagagccgcaagaccuucguggagcugaugcggcgcggggaccuccccgucuggcuggcccacaagguggccuccgagggcaucaaguacaccgaccggaaguggugcuucgacgggcagcgcaacaaccagauccuggaggagaacauggacgucgagaucuggacgaaggagggcgagaagaagaagcuccggccccgcuggcuggacgcccgcaccuacagcgacccccuggcgcucaaggaguucaaggacuucgccgccggccggaaguccaucgcccuggaccuggugaccgagaucgggcgcgugccgagccaccucgcccaccggacccgcaacgcgcuggacaaccuggucaugcuccacacguccgagcacggcgggcgggccuaccgccacgccguggaggagcugcccgagaccauggagacccugcuccugcugggccucaugauccugcugaccgggggcgccaugcuguuccugaucagcggcaaggggaucggcaagacgagcaucgggcugaucugcgugaucgccuccagcggcaugcucuggauggcggagaucccccugcaguggaucgccuccgccaucguccuggaguucuucaugauggugcuccugaucccggagcccgagaagcagcggacgccccaggacaaccagcuggccuacguggucaucgggauccucacccuggccgcgaucaucgccgccaacgagaugggccugcucgagaccacgaagaaggaccugggcaugagcaaggagcccggggugguguccagcaccuccuaccuggacgucgaccuccacccggccagcgcguggacccuguacgccguggccaccacggugaucacccccaugcugcgccacaccaucgagaacuccaccgccaacgucagccucgccgcgaucgccaaccaggccguggugcugaugggccuggacaagggguggcccaucuccaagauggaccucggcgucccccugcuggcccucgggugcuacagccaggugaacccgcugacgcugaccgccgcggugcuccugcugaucacccacuacgccaucaucggccccggccuccaggccaaggccacccgggaggcccagaagcgcacggcggccgggaucaugaagaaccccaccgucgacggcaucaugaccaucgaccuggaccccgugaucuacgacuccaaguucgagaagcagcugggccaggugaugcuccugguccugugcgccgugcagcuccugcugaugcggaccagcugggcccucugcgaggcgcugacgcuggccaccggcccgaucaccacccucugggagggcucccccgggaaguucuggaacacgaccaucgccgugagcauggccaacaucuuccgcggcuccuaccuggccggggcgggccuggccuucagcaucaugaaguccgucgggaccggcaagcggggcaccgggagccagggcgagacccucggggagaaguggaagaagaagcugaaccagcugagccgcaaggaguucgaccucuacaagaaguccggcaucacggagguggaccggaccgaggccaaggaggggcugaagcgcggcgagaucacccaccacgccgugagccggggcuccgccaagcugcagugguucgucgagcgcaacauggugauccccgaggggcgggugaucgaccucggcugcgggcgcggcggguggagcuacuacugcgcgggccugaagaaggucaccgaggugcggggcuacacgaagggcgggcccgggcacgaggagccggugcccauguccaccuacggcuggaacaucgucaagcugaugaccgggaaggacguguucuaccugccgcccgagaagugcgacacccugcugugcgacaucggcgagagcuccccgagccccacgguggaggagucccgcaccauccgcguccugaagaugguggagcccuggcucaagaacaaccaguucugcaucaaggugcugaaccccuacaugccgaccgucaucgagcaccuggagcggcuccagcgcaagcacggcgggaugcuggugcggaacccccugagccgcaacuccacccacgagauguacuggaucagcaacggcacggggaacaucguggccuccgucaacauggugagccggcuccugcugaaccgcuucaccaugacccaccggcgccccaccaucgagcgggacguggaccucggcgccggcacgcgccacgucaacgccgagcccgagaccccgaacauggacgugaucggggagcggaucaagcgcaucaaggaggagcacaacuccaccuggcacuacgacgacgagaaccccuacaagaccugggccuaccacggcagcuacgaggugaaggcgacgggguccgccagcuccaugaucaacggcgucgugaagcugcugaccaagcccugggacgucgugccgauggugacccagauggccaugaccgacacgacccccuucgggcagcagcgggucuucaaggagaagguggacacccgcacgccccggagcaugcccggcacgcgcaaggugaugggcaucaccgccgaguggcucuggcggacccuggggcgcaacaagaagccgcggcugugcacccgcgaggaguucacgaagaagguccgcaccaacgcggccaugggcgccguguucaccgaggagaaccagugggacagcgccaaggccgcgguggaggacgaggaguucuggaagcucgucgaccgggagcgcgagcugcacaagcuggggaagugcggcuccugcguguacaacaugauggggaagcgggagaagaagcucggcgaguucggcaaggccaaggggagccgcgccaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaccauccccgggggcgcgauguacgccgacgacacggccgggugggacacccgcaucaccgaggacgaccugcacaacgaggagaagaucacccagcagauggaccccgagcaccggcagcucgccaacgccaucuucaagcugaccuaccagaacaaggucgugaaggugcagcgccccacgccgaccggcaccgucauggacaucaucucccggaaggaccagcgcggcagcggccaggugggcaccuacgggcugaacacguucaccaacauggaggcgcagcucauccggcagauggagggcgagggggugcuguccaaggccgaccuggagaacccccaccuccccgagaagaagaucacccaguggcuggagaccaagggcgucgagcgccugaagcggauggccaucagcggcgacgacugcguggugaagcccaucgacgaccgcuucgccaacgcccuccuggcgcugaacgacauggggaagguccggaaggacaucccgcaguggcagcccuccaagggcuggcacgacuggcagcagguccccuucugcagccaccacuuccacgagcucaucaugaaggacgggcgcaagcuggugguccccugccggccgcaggacgagcugaucggccgcgcccggaucucccagggggccggcuggagccuccgcgagacggccugccugggcaaggcguacgcccagauguggucccugauguacuuccaccgccgggaccuccgccuggccagcaacgccaucugcuccgccgugcccgugcacuggguccccaccagccggaccaccugguccauccacgcgcaccaccaguggaugacgaccgagaacaugcugaccguguggaaccgcguguggaucgaggacaaccccuggauggaggacaagaccccggucacgaccugggagaacgugcccuaccucgggaagcgggaggaccaguggugcggcagccugaucgggcugaccagccgcgccaccugggcccagaacauccccacggccauccagcagguccggucccucaucggcaacgaggaguuccuggacuacaugcccagcaugaagcgcuuccggaaggaggaggaguccgagggggccaucugguga

SEQ ID NO: 9992 - RNA, 9873 nt, Artificial Sequence
  derived and/or modified CDS sequence (opt1) from DENV-3__FJ882575__SS-prME
accagccugugccugaugaugauccugcccgccacccuggccuuccaccucaccagccgggacggcgagccgcggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugacguacgggaccugcaaccaggccggcgagcaccggcgcgacaagcgguccguggcccucgcgccccacgugggcauggggcuggacacccgcacccagacguggaugagcgcggagggcgccuggcggcaggucgagaagguggagaccugggcccugcgccacccgggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacaucaccacggacagccgcugccccacccagggcgaggcggugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggccauccugcccgaguacggcacccuggggcucgagugcuccccgcgcacgggccuggacuucaacgagaugauccugcucaccaugaagaacaaggcguggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgccaugcacacggcgcucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgccccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcgggauccucaacagccugggcaagauggugcaccagaucuucggguccgcguacaccgcccuguucagcggcgucuccugggugaugaagaucggcaucggggugcuccugaccuggaucggccugaacagcaagaacaccuccaugagcuucuccugcaucgccaucgggaucaucacgcucuaccugggcgccgucgugcaggccgacauggggugcgugaucaacuggaagggcaaggagcugaagugcggcagcgggaucuucgucaccaacgaggugcacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccgucguggugggggacacgaucggcguccucgagcagggcaagcgcacccugacgccccagccgauggagcugaaguacuccuggaagaccugggggaaggccaagaucgugacggccgagacccagaacagcuccuucaucaucgacggccccaacacccccgagugccccagcgccucccgggcguggaacgugugggaggucgaggacuacggguucggcguguucaccaccaacaucuggcucaagcugcgcgagguguacacgcagcugugcgaccaccggcucaugagcgccgccgucaaggacgagcgcgccgugcacgccgacaugggcuacuggaucgagagccagaagaacggguccuggaagcuggagaaggcgagccugaucgaggugaagaccugcaccuggccgaagucccacacccucuggagcaacggcguccuggaguccgacaugaucauccccaagagccuggccgggcccaucucccagcacaacuaccggccgggcuaccacacgcagaccgccgggcccuggcaccucggcaagcuggagcuggacuucaacuacugcgagggcaccaccguggugaucacggagaacugcgggacccgcggccccagccuccggaccaccacggucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucaccaugggcgugcugugccucgccauccuguucgaggaggugaugcgggggaaguucggcaagaagcacaugaucgcgggggucuucuucaccuucgugcugcuccuguccggccagaucacguggcgcgacauggcccacacccugaucaugaucggcagcaacgccuccgaccggauggggaugggcgugaccuaccucgcccugaucgccaccuucaagauccagcccuuccuggcgcucggguucuuccugcgcaagcugacgagccgggagaaccuccugcugggcgucggccucgccauggccaccacccugcagcugcccgaggacaucgagcagauggccaacgggaucgcgcucggccugauggcccugaagcucaucacccaguucgagacguaccagcuguggaccgcccugaucagccugaccugcuccaacaccaucuucacgcugaccguggccuggcgcaccgccacccugauccucgcgggggugagccugcugccggucugccaguccagcuccaugcggaagacggacuggcuccccaugaccguggccgccaugggcgugccgccccucccgcuguucaucuucagccucaaggacacccugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggacguccgccgaccugaccguggagaaggccgcggacgugaccugggaggaggaggccgagcagaccggcgucagccacaaccugaugaucaccguggacgacgacgggacgaugcgcaucaaggacgacgagaccgagaacauccucaccgugcugcugaagaccgcccuccugaucgucuccggcaucuucccguacagcauccccgccacgcugcucguguggcacaccuggcagaagcagacccagcgguccggcgugcugugggacguccccagcccgcccgagacccagaaggccgagcuggaggaggggguguaccgcaucaagcagcagggcauccucgggaagacccaggugggcgucggggugcagaaggagggcguguuccacaccauguggcacgucacccggggcgcggugcugacccacaacgggaagcgccuggagcccaacugggccuccgugaagaaggaccucaucagcuacggcgggggcuggcggcuguccgcccaguggcagaagggggaggagguccaggugaucgccguggagcccggcaagaaccccaagaacuuccagacgaugcccggcaccuuccagaccaccacgggggagaucggcgcgaucgcccuggacuucaagcccgggaccagcggcagccccaucaucaaccgcgagggcaaggucguggggcuguacggcaacgggguggucaccaagaacggcggguacguguccggcaucgcccagaccaacgccgagccggacggccccacgcccgagcucgaggaggagauguucaagaagcggaaccugaccaucauggaccugcaccccgggagcggcaagacccgcaaguaccucccggccaucgugcgggaggcgaucaagcgccggcugcgcacccugauccucgcccccacgcgggucguggccgccgagauggaggaggcccugaaggggcugcccauccgcuaccagaccaccgcgaccaaguccgagcacacgggccgggagaucguggaccucaugugccacgccaccuucaccaugcgccugcugagccccguccgggugccgaacuacaaccucaucaucauggacgaggcccacuucaccgaccccgccuccaucgccgcgcgcggguacaucagcacgcgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucacggacuucgccgggaagaccgucugguucgugcccagcaucaaggcgggcaacgacaucgccaacugccugcggaagaacgggaagaaggugauccagcugucccgcaagaccuucgacaccgaguaccagaagacgaagcucaacgacugggacuucgucgugaccaccgacaucagcgagaugggcgccaacuucaaggccgaccgggugaucgacccgcgccggugccugaagcccgucauccugaccgacggccccgagcgcgugauccucgccgggcccaugccggugaccgcggccuccgccgcccagcggcgcggccgggucgggcgcaacccccagaaggagaacgaccaguacaucuucacgggccagccccugaacaacgacgaggaccacgcccacuggaccgaggcgaagaugcugcucgacaacaucaacacccccgaggggaucaucccggcccuguucgagcccgagcgggagaaguccgccgccaucgacggcgaguaccgccugaagggcgagucccggaagaccuucguggagcucaugcgccgcggggaccugcccguguggcuggcgcacaaggucgccagcgagggcaucaaguacacggaccgcaaguggugcuucgacgggcagcggaacaaccagauccucgaggagaacauggacguggagaucuggaccaaggagggcgagaagaagaagcugcgcccccgguggcuggacgcccgcaccuacuccgacccgcucgcccugaaggaguucaaggacuucgccgcgggccgcaagagcaucgcccuggaccucgucaccgagaucgggcgggugcccucccaccuggcccaccgcacgcggaacgcccuggacaaccucgugaugcugcacaccagcgagcacggcgggcgcgccuaccggcacgcggucgaggagcugcccgagaccauggagacccuccugcugcucggccugaugauccugcucaccggcggggccaugcuguuccugaucagcgggaaggggaucggcaagaccuccaucgggcucaucugcgugaucgccagcuccggcaugcuguggauggccgagaucccgcugcaguggaucgccagcgcgaucgugcucgaguucuucaugaugguccugcugauccccgagcccgagaagcagcgcacgccccaggacaaccagcucgccuacguggugaucgggauccugacccuggccgccaucaucgccgcgaacgagaugggccuccuggagacgaccaagcgggaccugggcauguccaaggagccgggggucgugagccccaccuccuaccucgacguggaccugcaccccgccagcgccuggacccuguacgccgucgcgacgaccgugaucacccccaugcuccgccacaccaucgagaacuccacggccaacgugagccuggccgccaucgccaaccaggcggucgugcugaugggccucgacaagggguggccgaucuccaagauggaccugggcgugccccugcucgcccuggggugcuacagccaggucaacccccugacccucaccgccgccgugcugcugcucaucacccacuacgccaucaucggccccggccugcaggcgaaggccacgcgggaggcccagaagcgcaccgccgccgggaucaugaagaacccgaccguggacggcaucaugaccaucgaccuggaccccgucaucuacgacuccaaguucgagaagcagcucggccaggugaugcugcuggugcucugcgcgguccagcugcugcucaugcggacgagcugggcccugugcgaggcccugacccucgccaccggccccaucaccacgcugugggagggcucccccgggaaguucuggaacaccaccaucgcggugagcauggccaacaucuuccgcggcuccuaccuggccggggccggccucgccuucagcaucaugaaguccguggggaccggcaagcggggcaccgggagccagggcgagacgcugggggagaaguggaagaagaagcugaaccagcucagccgcaaggaguucgaccuguacaagaaguccggcaucaccgaggucgaccggaccgaggcgaaggaggggcugaagcgcggcgagaucacccaccacgccgugagccggggcuccgccaagcuccagugguucguggagcgcaacauggucaucccggaggggcgggugaucgaccugggcugcgggcgcggcggguggagcuacuacugcgccggccugaagaaggugacggagguccggggcuacaccaagggcgggcccgggcacgaggagcccgugcccauguccaccuacggcuggaacaucgugaagcucaugagcgggaaggacgucuucuaccugccgcccgagaagugcgacacccugcugugcgacaucggcgaguccagccccucccccacgguggaggagagccgcaccauccgcgugcucaagauggucgagccguggcugaagaacaaccaguucugcaucaaggugcugaaccccuacaugcccaccgugaucgagcaccucgagcggcugcagcgcaagcacggcgggaugcugguccggaacccccucucccgcaacagcacccacgagauguacuggaucuccaacggcacggggaacaucgugagcuccgugaacauggucagccggcugcugcucaaccgcuucaccaugacccaccggcgcccgaccaucgagaaggacguggaccugggcgccggcacgcggcacguggacgcggagcccgagacccccaacauggacgucaucggggagcgcaucaagcggaucaaggaggagcacaacuccaccuggcacuacgacgacgagaacccguacaagaccugggccuaccacggcagcuacgaggugaaggccacgggguccgccagcagcaugaucaacggcguggucaagcugcucaccaagcccugggacgugguccccauggugacccagauggccaugaccgacacgacccccuucgggcagcagcgcguguucaaggagaaggucgacacccggaccccgcgccccaugcccggcacgcggaaggugaugggcaucaccgcggaguggcuguggcgcacccuggggcggaacaagcgcccccggcucugcacccgcgaggaguucacgaagaaggugcgcaccaacgccgccaugggcgccgucuucaccgaggagaaccagugggacuccgcgaaggccgccguggaggacgaggaguucuggaagcugguggaccgggagcgcgagcugcacaagcucgggaagugcggcagcugcgucuacaacaugauggggaagcgggagaagaagcugggcgaguucggcaaggccaaggggucccgcgccaucugguacauguggcugggcgcgcgguaccucgaguucgaggcccugggguuccugaacgaggaccacugguucagccgcgagaacuccuacagcggcguggagggggagggccuccacaagcugggcuacauccugcgggacaucuccaagauccccgggggcgccauguacgccgacgacaccgccgggugggacacgcgcaucaccgaggacgaccuccacaacgaggagaagaucacccagcagauggaccccgagcaccggcagcuggcgaacgccaucuucaagcugaccuaccagaacaagguggucaaggugcagcgccccacccccacgggcaccgugauggacaucaucagccggaaggaccagcgcggcuccgggcaggucggcaccuacgggcucaacaccuucacgaacauggaggcccagcuggugcggcagauggagggcgagggggugcugagcaaggccgaccucgagaacccgcaccuccccgagaagaagaucacccaguggcuggagaccaagggcgucgagcgccucaagcggauggccaucuccggcgacgacugcguggugaagcccaucgacgaccgcuucgcgaacgcccugcuggcccucaacgacauggggaagguccggaaggacaucccccaguggcagccgagcaagggcuggcacgacuggcagcagguccccuucugcucccaccacuuccacgagcugaucaugaaggacgggcgcaagcuggugguccccugccggccccaggacgagcucaucggccgcgcccggaucagccagggggccggcuggucccugcgcgagaccgcgugccugggcaaggccuacgcccagauguggagccucauguacuuccaccgccgggaccugcgccuggccuccaacgcgaucugcagcgccgugccggugcacuggguccccacgucccggaccaccuggagcauccacgcccaccaccaguggaugaccacggaggacaugcucaccguguggaaccgcguguggaucgaggacaaccccuggauggaggacaagacccccgucaccacgugggagaacgugccguaccuggggaagcgggaggaccaguggugcggcagccugaucgggcucaccucccgcgccaccugggcccagaacauccccaccgcgauccagcagguccggagccugaucggcaacgaggaguuccuggacuacaugcccuccaugaagcgcuuccggaaggaggaggagagcgagggggccaucugguga

SEQ ID NO: 9993 - RNA, 9873 nt, Artificial Sequence
  derived and/or modified CDS sequence (opt1) from DENV-3__GQ199886__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaugggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacggucgccuggcgcaccgccacccugauccucgcgggggugagccugcugccggucugccaguccagcuccaugcggaagaccgacuggcuccccaugacgguggccgccaugggcgugccgccccucccgcuguucaucuucagccucaaggacacccugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugacggucgagaaggccgcggacgugaccugggaggaggaggccgagcagaccggcgugagccacaaccugaugaucaccgucgacgacgacgggaccaugcgcaucaaggacgacgagacggagaacauccucaccgugcugcugaagaccgcccuccugaucguguccggcaucuucccguacagcauccccgccacccugcucgucuggcacacguggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcacguuccagaccaccaccggggagaucggcgcgaucgcccuggacuucaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcuggaggaggagauguucaagaagcggaaccucacgaucauggaccugcaccccgggagcggcaagacccgcaaguaccugccggccaucgugcgggaggcgaucaagcgccggcuccgcacccugauccuggcccccacccggguggucgccgccgagauggaggaggcccucaaggggcugcccauccgcuaccagacgaccgcgaccaaguccgagcacaccggccgggagaucguggaccugaugugccacgccacguucaccaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagaaggacauccccgagcgcagcuggaacuccggcaacgaguggaucaccgacuucgccgggaagacggugugguucguccccagcaucaaggcgggcaacgacaucgccaacugccuccgcaagaacgggaagaaggugauccagcugucccggaagaccuucgacaccgaguaccagaagaccaagcugaacgacugggacuucguggucacgaccgacaucagcgagaugggcgccaacuucaaggccgaccgcgugaucgacccgcggcgcugccucaagcccgugauccugaccgacggccccgagcgggucauccuggccgggcccaugccggugaccgcggccuccgccgcccagcgccggggccgcguggggcggaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgcgagaaguccgccgccaucgacggcgaguaccggcugaagggcgagucccgcaagaccuucgucgagcugaugcggcgcggggaccuccccguguggcuggcgcacaaggucgccagcgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccggaccuacuccgacccgcuggcccucaaggaguucaaggacuucgccgcgggccgcaagagcaucgcccuggaccuggugaccgagaucgggcgcguccccucccaccucgcccaccggacccgcaacgcccuggacaaccuggugaugcuccacacgagcgagcacggcgggcgggccuaccgccacgcgguggaggagcugcccgagaccauggagacccugcuccugcugggccucaugauccugcugaccgggggcgccaugcuguuccugaucagcggcaaggggaucggcaagacguccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcauguccaaggagccggggguggucagccccaccuccuaccuggacguggaccuccaccccgccagcgccuggacccuguacgccguggcgaccacggucaucacccccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacgcuggccaccggccccaucaccacccucugggagggcucccccgggaaguucuggaacacgaccaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacacgaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccaccgucgaggagagccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucacgaugacccaccgccggccgaccaucgagaaggacgucgaccucggcgcgggcacccgccacgugaacgccgagcccgagacgcccaacauggacgugaucggggagcggaucaagcgcaucaaggaggagcacaacagcaccuggcacuacgacgacgagaacccguacaagaccugggccuaccacggcuccuacgaggucaaggccaccgggagcgccuccagcaugaucaacggcguggucaagcugcugacgaagcccugggacguggugcccauggucacccagauggcgaugaccgacaccacgcccuucgggcagcagcggguguucaaggagaagguggacacccgcaccccgcggagcaugcccggcacccgccgggucaugggcaucacggccgaguggcucuggcgcacccuggggcggaacaagaagccccgccugugcacccgggaggaguucaccaagaaggugcgcacgaacgccgccaugggcgcgguguucaccgaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggugaagguccagcggcccacccccaccggcacggugauggacaucaucagccgcaaggaccagcggggcuccggccaggugggcaccuacgggcugaacaccuucaccaacauggaggcccagcucauccgccagauggagggcgaggggguccugagcaaggccgaccuggagaacccccaccucccggagaagaagaucacgcaguggcuggagaccaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccgugcccguccacugggugccgaccucccgcacgaccuggagcauccacgcccaccaccaguggaugaccaccgaggacaugcugacgguguggaaccgggucuggaucgaggacaaccccuggauggaggacaagacccccgugaccaccugggagaacgugcccuaccucgggaagcgcgaggaccaguggugcggcagccugaucgggcugacgucccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 9994 - RNA, 9873 nt, Artificial Sequence
  derived and/or modified CDS sequence (opt1) from DENV-3__FJ882576__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcauggccaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgucccgugcaagauccccuucagcaccgaggacgggcagggcaaggcccacaacggccgccugaucaccgccaaccccguggugacgaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgugggcgggguccucaacagccugggcaagauggugcaccagaucuucggguccgccuacaccgcccuguucagcggcguguccugggucaugaagaucggcaucggggugcuccugacguggaucggccugaacagcaagaacaccuccaugagcuucuccugcaucgccaucgggaucaucacccucuaccugggcgccgugguccaggcggacauggggugcgugaucaacuggaagggcaaggagcugaagugcggcagcgggaucuucgugaccaacgagguccacacguggaccgagcaguacaaguuccaggccgacucccccaagcgccucgccaccgccaucgccggcgcgugggagaacggggugugcggcauccgcagcaccacgcggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagacgugggggaaggccaagaucgucaccgccgagacccagaacagcuccuucaucaucgacggccccaacacccccgagugccccagcgcgucccgggccuggaacgugugggagguggaggacuacggguucggcgucuucacgaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcaccuggccgaagucccacacgcucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcaccacggucgugaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgcgauccuguucgaggaggugaugcgggggaaguucggcaagaagcacaugaucgccgggguguucuucacguucguccugcuccuguccggccagaucaccuggcgcgacauggcccacacccugaucaugaucggcagcaacgccuccgaccggauggggaugggcgugaccuaccucgcccugaucgcgacguucaagauccagcccuuccuggcccucggguucuuccugcgcaagcugaccagccgggagaaccuccugcugggcgugggccucgccauggccaccacccugcagcugcccgaggacaucgagcagauggcgaacgggaucgcccucggccugauggcccugaagcucaucacgcaguucgagaccuaccagcuguggaccgcccugaucagccugaccugcuccaacacgaucuucacccugaccgucgccuggcgcaccgcgacgcugauccucgccggggugagccugcugccggucugccaguccagcuccaugcggaagaccgacuggcuccccaugaccguggccgccaugggcgugccgccccucccgcuguucaucuucagccucaaggacacccugaagcgccgcuccuggccccugaacgagggggucauggccgugggccucgugagcauccuggcguccagccugcuccggaacgacguccccauggccggcccccugguggccgggggccugcucaucgccugcuacgugaucacggggaccuccgccgaccugaccgucgagaaggcggccgacgugaccugggaggaggaggccgagcagacgggcgugagccacaaccugaugaucaccgucgacgacgacgggaccaugcgcaucaaggacgacgagaccgagaacauccucaccgugcugcugaagacggcccuccugaucguguccggcaucuucccguacagcauccccgccacccugcucgucuggcacaccuggcagaagcagacccagcgguccggcgugcugugggacgugcccagcccgcccgagacgcagaaggcggagcuggaggagggggucuaccgcaucaagcagcagggcaucuucgggaagacccaggugggcguggggguccagaaggagggcguguuccacaccauguggcacgugacccggggcgccguccucgccuacaacgggaagcgccuggagcccaacugggccuccgugaagaaggaccugaucagcuacggcgggggcuggcggcucuccgcgcaguggcagaagggggaggaggugcaggucaucgccguggagcccggcaagaaccccaagaacuuccagacgaugcccggcaccuuccagaccaccacgggggagaucggcgccaucgcccuggacuucaagcccgggaccagcggcagccccaucaucaaccgcgagggcaagguggucgggcuguacggcaacgggguggugaccaagaacggcggguacgucuccggcaucgcccagaccaacgcggagccggacggccccacgcccgagcuggaggaggagauguucaagaagcggaaccucaccaucauggaccugcaccccgggagcggcaagacccgcaaguaccugccggccaucgugcgggaggccaucaagcgccggcuccgcacccugauccuggcccccacgcggguggucgccgcggagauggaggaggcccucaaggggcugcccauccgcuaccagaccaccgccaccaaguccgagcacacgggccgggagaucguggaccugaugugccacgccaccuucaccaugcgccuccugagccccgugcgggucccgaacuacaaccugaucaucauggacgaggcccacuucaccgaccccgcguccaucgccgcccgcggguacaucagcacgcgggugggcaugggcgaggccgcggccaucuucaugaccgccacgccgcccgggaccgccgacgccuucccgcaguccaacgcgcccauccaggacgaggagcgcgacauccccgagcgcagcuggaacuccggcaacgaguggaucacggacuucgccgggaagaccgugugguucguccccagcaucaaggccggcaacgacaucgccaacugccuccggaagaacgggaagaaggugauccagcugucccgcaagaccuucgacaccgaguaccagaagacgaagcugaacgacugggacuucguggucaccaccgacaucagcgagaugggcgccaacuucaaggcggaccgggugaucgacccgcgccggugccucaagcccgugauccugaccgacggccccgagcgcgucauccuggccgggcccaugccggugacggccgccuccgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagucccggaagaccuucgucgagcugaugcgccgcggggaccuccccguguggcuggcccacaaggucgccagcgagggcaucaaguacacggaccgcaaguggugcuucgacggggagcggaacaaccagauccuggaggagaacauggacguggagaucuggaccaaggagggcgagaagaagaagcuccgcccccgguggcuggacgcccgcaccuacuccgacccgcuggcgcucaaggaguucaaggacuucgccgccggccgcaagagcaucgcccuggaccuggugaccgagaucgggcggguccccucccaccucgcccaccgcacgcggaacgcgcuggacaaccuggugaugcuccacaccagcgagcacggcgggcgcgccuaccggcacgccguggaggagcugcccgagaccauggagacccugcuccugcugggccucaugauccugcugaccggcggggccaugcuguuccugaucagcgggaaggggaucggcaagaccuccaucgggcugaucugcgucaucgccagcuccggcaugcucuggauggcggagaucccgcugcaguggaucgccagcgccaucgugcuggaguucuucaugauggugcuccugauccccgagcccgagaagcagcgcacgccccaggacaaccagcuggccuacgucgugaucgggauccucacccuggccgcgaucaucgccgccaacgagaugggccugcucgagacgaccaagcgggaccugggcauguccaaggagccggggguggucagccccaccuccuaccuggacguggaccuccaccccgccagcgcguggacccuguacgccguggccacgaccgucaucacccccaugcugcgccacaccaucgagaacuccacggccaacgugagccucgccgcgaucgccaaccaggccgugguccugaugggccuggacaagggguggccgaucuccaagauggaccucggcgugccccugcuggcccucgggugcuacagccaggugaacccccugacccugaccgccgcgguccuccugcugaucacccacuacgccaucaucggccccggccuccaggccaaggccacgcgggaggcccagaagcgcaccgcggccgggaucaugaagaacccgaccguggacggcaucaugaccaucgaccuggaccccgugaucuacgacuccaaguucgagaagcagcuggggcaggucaugcuccuggugcugugcgccgugcagcuccugcugaugcggacgagcugggcccucugcgaggcgcugacccuggccaccggccccaucaccacgcucugggagggcucccccgggaaguucuggaacaccaccaucgccgucagcauggccaacaucuuccgcggcuccuaccuggccggggcgggccuggccuucagcaucaugaaguccguggggaccggcaagcggggcacggggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagaucacccaccacgccgucagccggggcuccgccaagcugcagugguucguggagcgcaacauggugaucccggaggggcgggucaucgaccucggcugcgggcgcggcggguggagcuacuacugcgcgggccugaagaaggugacggaggugcggggcuacaccaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccacggucgaggagagccgcaccauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugucccgcaacagcacccacgagauguacuggaucuccaacggcacggggaacaucgucagcuccgugaacauggugagccggcuccugcugaaccgcuucaccaugacccaccggcgcccgaccaucgagaaggacgucgaccucggcgccggcacgcggcacgugaacgccgagcccgagacccccaacauggacgugaucggggagcgcaucaagcggaucaaggaggagcacaacuccaccuggcacuacgacgacgagaacccguacaagaccugggccuaccacggcagcuacgaggucaaggccacgggguccgcgagcagcaugaucaacggcguggucaagcugcugaccaagcccugggacguggugcccauggucacccagauggccaugaccgacacgacccccuucgggcagcagcgcguguucaaggagaagguggacacccggaccccgcgcuccaugcccggcacgcggcgcgucaugggcaucaccgccgaguggcucuggcggacccuggggcgcaacaagaagccccggcugugcacccgcgaggaguucacgaagaaggugcgcaccaacgccgcgaugggcgccguguucaccgaggagaaccagugggacagcgccaaggccgccgucgaggacgaggacuucuggaagcucguggaccgggagcgcgagcugcacaagcuggggaagugcggcuccugcguguacaacaugauggggaagcgggagaagaagcucggcgaguucggcaaggcgaaggggagccgcgccaucugguacauguggcugggcgcccgguaccuggaguucgaggcccucggguuccugaacgaggaccacugguucucccgcgagaacagcuacuccggcgucgagggggagggccugcacaagcucggcuacauccugcgggacaucagcaagauccccgggggcgccauguacgcggacgacaccgccgggugggacacgcgcaucaccgaggacgaccugcacaacgaggagaagaucacccagcagauggacccggagcaccggcagcucgccaacgccaucuucaagcugaccuaccagaacaagguggugaagguccagcgccccacgcccaccggcaccgugauggacaucaucucccggaaggaccagcgcggcagcggccaggugggcaccuacgggcugaacaccuucacgaacauggaggcccagcucauccggcagauggagggcgaggggguccuguccaaggcggaccuggagaacccccaccucccggagaagaagaucacccaguggcuggagaccaagggcguggagcgccugaagcggauggccaucagcggcgacgacugcguggucaagcccaucgacgaccgcuucgccaacgcccuccuggcccugaacgacauggggaaggugcggaaggacaucccccaguggcagcccuccaagggcuggcacgacuggcagcaggucccguucugcagccaccacuuccacgagcucaucaugaaggacgggcgcaagcuggucgugcccugccggccccaggacgagcugaucggccgcgcgcggaucucccagggggccggcuggagccuccgcgagaccgccugccugggcaaggccuacgcgcagauguggucccugauguacuuccaccgccgggaccuccgccuggccagcaacgccaucugcuccgccgugcccguccacugggugccgacgagccggaccaccuggagcauccacgcccaccaccaguggaugaccacggaggacaugcugaccguguggaaccgcgucuggaucgaggacaaccccuggauggaggacaagacccccgugaccacgugggagaacgugcccuaccucgggaagcgggaggaccaguggugcggcucccugaucgggcugaccagccgcgcgaccugggcccagaacaucccgaccgccauccagcagguccggucccucaucggcaacgaggaguuccuggacuacaugcccagcaugaagcgcuuccggaaggaggaggaguccgagggggccaucugguga

SEQ ID NO: 9995 - RNA, 9873 nt, Artificial Sequence
  derived and/or modified CDS sequence (opt1) from DENV-3__FJ850052__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucgggcucaaggacacgcugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugaccgucgagaaggccgcggacaucacgugggaggaggaggccgagcagaccggggugucccacaaccugaugaucaccguggacgacgacggcaccaugcgcaucaaggacgacgagaccgagaacauccucacgguccugcugaagaccgcccuccugaucgugagcggcaucuucccguacuccauccccgccacccugcucguguggcacaccuggcagaagcagacgcagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacaccauguggcacgugacgcgcggggcggugcucaccuacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggaccuuccagacgaccaccggcgagaucggggcgaucgcccuggacuucaagcccggcaccuccggcagccccaucaucaaccgcgaggggaagguggugggccuguacgggaacggcgucgugacgaagaacgggggcuacgugagcggcaucgcccagaccaacgccgagccggacgggcccacccccgagcuggaggaggagauguucaagaagcggaaccucaccaucauggaccugcaccccggcuccgggaagacgcgcaaguaccugccggccaucguccgggaggcgaucaagcgccggcuccgcacccugauccuggcccccacccgggugguggccgccgagauggaggaggcccucaagggccugcccauccgcuaccagaccacggcgaccaagagcgagcacaccgggcgggagaucgucgaccugaugugccacgccaccuucacgaugcgccuccugucccccgugcgggugccgaacuacaaccugaucaucauggacgaggcccacuucaccgaccccgccagcaucgccgcgcgcggcuacaucuccacccgggucggcaugggggaggccgccgccaucuucaugaccgcgacgccgcccggcaccgccgacgccuucccgcagagcaacgcccccauccaggacaaggagcgcgacauccccgagcgcuccuggaacagcgggaacgaguggaucaccgacuucgccggcaagaccgugugguucgugcccuccaucaaggcggggaacgacaucgccaacugccuccggaagaacggcaagaaggucauccagcugagccgcaagacguucgacaccgaguaccagaagaccaagcugaacgacugggacuucguggugaccacggacaucuccgagaugggcgccaacuucaaggccgaccgggucaucgacccgcgccggugccucaagcccgugauccugaccgacgggcccgagcgcgugauccuggccggccccaugccggucaccgcggccagcgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacgcccgagggcaucaucccggcccucuucgagcccgagcgggagaaguccgccgccaucgacggcgaguaccgccugaagggggagagccggaagaccuucguggagcugaugcgccggggcgaccuccccgucuggcuggcgcacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcacguacagcgacccgcuggcccucaaggaguucaaggaguucgccgcggggcgcaaguccaucgcccuggaccuggugaccgagaucggccgggugcccagccaccucgcccaccgcacccggaacgcccuggacaaccuggucaugcuccacaccuccgagcacgggggccgcgccuaccggcacgcgguggaggagcugcccgagacgauggagacccugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgccuccgcgaucguccuggaguucuucaugauggugcuccugauccccgagcccgagaagcagcgcacgccccaggacaaccagcuggccuacguggucaucggcauccucacccuggccgccaucaucgccgcgaacgagaugggccugcucgagaccaccaagcgggaccuggggaugagcaaggagccgggcguggugucccccacgagcuaccuggacgucgaccuccaccccgccuccgccuggacccuguacgccguggcgaccaccgugaucacgcccaugcugcgccacaccaucgagaacagcaccgccaacgucucccucgccgccaucgccaaccaggcgguggugcugauggggcuggacaagggcuggccgaucagcaagauggaccucggggucccccugcuggcccucggcugcuacucccaggugaacccccugacccugacggccgccgugcuccugcugaucacccacuacgccaucaucggccccgggcuccaggcgaaggccacccgggaggcccagaagcgcaccgccgccggcaucaugaagaacccgacggucgacgggaucaugaccaucgaccuggaccccgugaucuacgacagcaaguucgagaagcagcugggccaggugaugcuccugguccugugcgcggugcagcuccugcugaugcggaccuccugggcccucugcgaggcccugacccuggccacgggccccaucaccacccucugggaggggagccccggcaaguucuggaacaccacgaucgcgguguccauggccaacaucuuccgcgggagcuaccuggccggcgccgggcuggccuucuccaucaugaaguccgucggcaccggcaagcgggggaccggcucccagggggagacccucggcgagaaguggaagaagaagcugaaccagcugagccgcaaggacuucgaccucuacaagaaguccgggaucaccgagguggaccggacggaggcgaaggagggccugaagcgcggcgagaucacccaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacaccaagggcgggcccggccacgaggagcccgugcccaugagcacguacggguggaacaucgucaagcugauguccggcaaggacguguucuaccucccgcccgagaagugcgacacccugcugugcgacaucggcgagagcucccccagccccaccguggaggagucccgcaccauccgcguccugaagaugguggagccguggcucaagaacaaccaguucugcaucaaggugcugaaccccuacaugcccacggucaucgagcaccuggagcggcuccagcgcaagcacgggggcaugcuggugcggaacccccugagccgcaacuccacccacgagauguacuggaucagcaacgggaccggcaacaucguggccuccgucaacauggugagccggcuccugcugaaccgcuucaccaugacgcaccggcgcccgaccaucgagaaggacguggaccucggcgcggggacccggcacgucaacgccgagcccgagacccccaacauggacgugaucggcgagcgcaucaagcggaucaaggaggagcacaacuccacguggcacuacgacgacgagaacccguacaagaccugggccuaccacgggagcuacgaggugaaggccaccggcuccgccagcuccaugaucaacggggucgugaagcugcugaccaagcccugggacgucgugcccauggugacgcagauggcgaugaccgacaccacccccuucggccagcagcgcgucuucaaggagaagguggacacgcggaccccgcgcagcaugcccggcacccggcgcgugauggggaucaccgccgaguggcucuggcggacgcugggccgcaacaagaagccccggcugugcacccgcgaggaguucaccaagaagguccgcaccaacgccgccaugggggcgguguucacggaggagaaccagugggacagcgccaaggccgccguggaggacgaggacuucuggaagcucgucgaccgggagcgcgagcugcacaagcugggcaagugcggguccugcguguacaacaugaugggcaagcgggagaagaagcucggcgaguucgggaaggccaagggcagccgcgcgaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgccgacgacaccgcgggcugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucucccggaaggaccagcgcgggagcggccagguggggacguacggccugaacaccuucaccaacauggaggcccagcucauccggcagauggagggggagggcgugcuguccaaggccgaccuggagaacccccaccucccggagaagaagaucacccaguggcuggagacgaagggcgucgagcgccugaagcggauggcgaucagcggggacgacugcguggugaagcccaucgacgaccgcuucgccaacgcccuccuggcccugaacgacaugggcaagguccggaaggacaucccccaguggcagcccuccaagggguggcacgacuggcagcaggucccguucugcagccaccacuuccacgagcucaucaugaaggacggccgcaagcuggugguccccugccggccccaggacgagcugaucgggcgcgcccggaucucccagggcgcgggcuggagccucaaggagaccgccugccuggggaaggccuacgcccagauguggucccugauguacuuccaccgccgcgaccuccggcuggcgagcaacgccaucugcuccgccgugcccgugcacugggucccgaccagccgcaccacgugguccauccacgcccaccaccaguggaugaccaccgaggacaugcugaccguguggaaccggguguggaucgaggacaaccccuggauggaggacaagacgcccgucaccaccugggagaacgugcccuaccucggcaagcgcgaggaccaguggugcgggagccugaucggccugaccagccgggccacgugggcgcagaacaucccgaccgccauccagcagguccgcucccucaucgggaacgaggaguuccuggacuacaugcccagcaugaagcgguuccgcaaggaggaggaguccgagggcgccaucugguga

SEQ ID NO: 9996 - RNA, 9873 nt, Artificial Sequence
  derived and/or modified CDS sequence (opt1) from DENV-3__FJ873812__SS-prME
accagccugugccucaugaugauccugcccgcggcccuggcguuccaccucaccagccgggacggggagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucuccaacgagcucaacuacauccugugggagaacaacaucaagcugaccgugguggucggggacaucaucggcgugcucgagcagggcaagcgcacgcugacgccccagccgauggagcugaaguacagcuggaagaccugggggaaggcgaagaucgugaccgccgagacgcagaacuccagcuucaucaucgacggccccaacacccccgagugccccuccgucagccgggccuggaacgugugggagguggaggacuacggguucggcgucuucaccaccaacaucuggcucaagcugcgcgagguguacacccagcugugcgaccaccggcucaugagcgccgcggugaaggacgagcgcgccguccacgccgacaugggcuacuggaucgagucccagaagaacgggagcuggaagcuggagaaggccucccugaucgaggugaagacgugcaccuggcccaagagccacacccucugguccaacggcgugcuggagagcgacaugaucauccccaagucccuggccgggcccaucagccagcacaaccaccggccgggcuaccacacccagacggcggggcccuggcaccucggcaagcuggagcuggacuucaacuacugcgagggcaccaccgucgugaucaccgagaacugcgggacgcgcggccccucccuccggaccaccaccgugagcgggaagcugauccacgaguggugcugccgcuccugcacgcugcccccgcuccgguacaugggcgaggacgggugcugguacggcauggagauccgccccaucagcgagaaggaggagaacauggucaagucccuggugagcgccggcuccgggaagguggacaacuucaccaugggcguccugugccucgccauccuguucgaggaggugaugcgggggaaguucggcaagaagcacaugaucgccgggguguuccugaccuucguccuccugcugagcggccagaucaccuggcgcgacauggcccacacgcucaucaugaucggcuccaacgcgagcgaccggauggggaugggcgugaccuaccuggcccugaucgccaccuucaagauccagcccuuccucgcccugggguucuuccugcgcaagcucaccagccgggagaaccugcugcucggcgugggccuggccauggcgacgacccugcagcuccccgaggacaucgagcagauggccaacgggaucgcccugggccugauggcccucaagcugaucacccaguucgagaccuaccagcuguggacggcgcucaucucccugaccugcagcaacaccaucuucacccugacggucgccuggcgcaccgccacccucauccuggccggggugucccugcucccggucugccagagcuccagcaugcggaagaccgacuggcugcccauggccguggcggccaugggcgugccgccccugccccuguucaucuucucccugaaggacacgcugaagcgccgcagcuggccccucaacgagggggucauggccgugggccugguguccauccuggccagcucccuccugcggaacgacguccccauggccggcccccugguggccggcgggcuccugaucgccugcuacgugaucaccgggaccagcgccgaccugaccgucgagaaggccgccgacaucacgugggaggaggaggcggagcagaccggggugucccacaaccucaugaucaccguggacgacgacgggaccaugcgcaucaaggacgacgagaccgagaacauccugacgguccugcucaagaccgcccugcugaucgugagcggcaucuucccguacuccauccccgccacccuccugguguggcacaccuggcagaagcagacgcagcggagcggcguccugugggacgugcccagcccgcccgagacccagaaggccgagcucgaggaggggguguaccgcaucaagcagcagggcaucuucgggaagacccaggucggcgugggggugcagaaggagggcgucuuccacaccauguggcacgugacgcggggcgccgugcugaccuacaacgggaagcgccuggagcccaacugggcgagcgucaagaaggaccucaucuccuacggcgggggcuggcggcugagcgcccaguggcagaagggggaggagguccaggugaucgccgucgagcccggcaagaaccccaagaacuuccagaccaugccgggcaccuuccagacgaccaccggggagaucggcgccaucgcgcuggacuucaagcccgggaccagcggcucccccaucaucaaccgcgagggcaaggugguggggcuguacggcaacggggucgugacgaagaacggcggguacgugagcggcaucgcccagaccaacgccgagccggacggccccacccccgagcucgaggaggagauguucaagaagcggaaccugaccaucauggaccugcaccccggguccggcaagacgcgcaaguaccucccggccaucguccgggaggccaucaagcgccggcugcgcacccugauccucgcgcccacccgggugguggccgccgagauggaggaggcccugaaggggcugcccauccgcuaccagaccacggccaccaagagcgagcacaccggccgggagaucgucgaccucaugugccacgcgaccuucacgaugcgccugcugucccccgugcgggugccgaacuacaaccucaucaucauggacgaggcccacuucaccgaccccgccagcaucgccgcccgcggguacaucuccacccgggucggcaugggcgaggcggccgccaucuucaugaccgccacgccgcccgggaccgcggacgccuucccgcagagcaacgcccccauccaggacgaggagcgcgacauccccgagcgcuccuggaacagcggcaacgaguggaucaccgacuucgccgggaagaccgugugguucgugcccuccaucaaggccggcaacgacaucgcgaacugccugcggaagaacgggaagaaggucauccagcugagccgcaagacguucgacaccgaguaccagaagaccaagcucaacgacugggacuucguggugaccacggacaucuccgagaugggcgccaacuucaaggccgaccgggucaucgacccgcgccggugccugaagcccgugauccugaccgacggccccgagcgcgugauccucgccgggcccaugccggucaccgccgcgagcgccgcccagcggcgcggccggguggggcgcaacccccagaaggagaacgaccaguacaucuucaccggccagccccugaacaacgacgaggaccacgcccacuggaccgaggccaagaugcugcucgacaacaucaacacgcccgaggggaucaucccggcgcuguucgagcccgagcgggagaaguccgccgccaucgacggcgaguaccgccugaagggcgagagccggaagaccuucguggagcucaugcgccgcggggaccugcccgucuggcuggcccacaagguggcguccgagggcaucaaguacaccgaccgcaaguggugcuucgacgggcagcggaacaaccagauccucgaggagaacauggacgucgagaucuggaccaaggagggcgagaagaagaagcugcgcccccgguggcuggacgcccgcacguacagcgacccgcucgcccugaaggaguucaaggaguucgccgccggccgcaaguccaucgcgcuggaccucgugaccgagaucgggcgggugcccagccaccuggcccaccgcacccggaacgcccuggacaaccucgucaugcugcacaccagcgagcacggcgggcgcgccuaccggcacgccguggaggagcugcccgagacgauggagacccuccugcugcucggccugaugauccugcucaccgggggcgcgaugcuguuccugaucuccggcaaggggaucggcaagaccagcaucgggcucaucugcgugaucgccuccagcggcaugcuguggauggccgagaucccgcugcaguggaucgccuccgccaucguccucgaguucuucaugauggugcugcugauccccgagcccgagaagcagcgcacgccccaggacaaccagcucgcguacguggucaucgggauccugacccuggccgccaucaucgccgccaacgagaugggccuccuggagaccaccaagcgggaccugggcaugagcaaggagccggggguggugucccccacgagcuaccucgacgucgaccugcaccccgcguccgccuggacccuguacgccguggccaccaccgugaucacgcccaugcuccgccacaccaucgagaacagcaccgcgaacgucucccuggccgccaucgccaaccaggccguggugcugaugggccucgacaagggguggccgaucagcaagauggaccugggcgucccccugcucgcgcuggggugcuacucccaggugaacccccugacccucacggccgccgugcugcugcucaucacccacuacgccaucaucggccccggccugcaggccaaggcgacccgggaggcccagaagcgcaccgccgccgggaucaugaagaacccgacggucgacggcaucaugaccaucgaccuggaccccgugaucuacgacagcaaguucgagaagcagcucggccaggugaugcugcugguccucugcgccgugcagcugcugcucaugcggaccuccugggcgcugugcgaggcccugacccucgccacgggccccaucaccacccugugggagggcagccccgggaaguucuggaacaccacgaucgccguguccauggcgaacaucuuccgcggcagcuaccuggccggggccggccucgccuucuccaucaugaaguccgucgggaccggcaagcggggcaccgggagccagggcgagacccugggggagaaguggaagaagaagcugaaccagcucucccgcaaggacuucgaccuguacaagaaguccggcaucaccgagguggaccggacggaggccaaggaggggcugaagcgcggcgagaucacccaccacgcggugucccggggcagcgccaagcuccagugguucgucgagcgcaacauggugaucccggaggggcgggugaucgaccugggcugcgggcgcggcgggugguccuacuacugcgccggccugaagaaggucaccgaggugcggggcuacaccaagggcgggcccgggcacgaggagcccgugcccaugagcacguacggcuggaacaucgucaagcucauguccgggaaggacguguucuaccugccgcccgagaagugcgacacccugcugugcgacaucggcgagagcucccccagccccaccguggaggagucccgcaccauccgcguccucaagaugguggagccguggcugaagaacaaccaguucugcaucaaggugcugaaccccuacaugcccacggucaucgagcaccucgagcggcugcagcgcaagcacggcgggaugcuggugcggaacccccucagccgcaacuccacccacgagauguacuggaucagcaacggcaccgggaacaucguggccuccgucaacauggugagccggcugcugcucaaccgcuucaccaugacgcaccggcgcccgaccaucgagaaggacguggaccugggcgccggcacccggcacgucaacgcggagcccgagacccccaacauggacgugaucggggagcgcaucaagcggaucaaggaggagcacaacuccacguggcacuacgacgacgagaacccguacaagaccugggccuaccacggcagcuacgaggugaaggccaccggguccgccagcagcaugaucaacggcgucgugaagcugcucaccaagcccugggacgucgugcccauggugacgcagauggccaugaccgacaccacccccuucgggcagcagcgcgucuucaaggagaagguggacacgcggaccccgcgcuccaugcccggcacccggcgcgugaugggcaucaccgcggaguggcuguggcggacgcuggggcgcaacaagaagccccggcucugcacccgcgaggaguucaccaagaagguccgcaccaacgccgccaugggcgccguguucacggaggagaaccagugggacagcgcgaaggccgccguggaggacgaggacuucuggaagcuggucgaccgggagcgcgagcugcacaagcucgggaagugcggcuccugcguguacaacaugauggggaagcgggagaagaagcugggcgaguucggcaaggccaaggggagccgcgccaucugguacauguggcugggcgcgcgguaccucgaguucgaggcccugggguuccugaacgaggaccacugguucucccgcgagaacagcuacuccggcguggagggggagggccuccacaagcugggcuacauccugcgggacaucagcaagauccccgggggcgccauguacgccgacgacaccgccgggugggacacccgcaucaccgaggacgaccuccacaacgaggagaagaucacgcagcagauggacccggagcaccggcagcuggcgaacgccaucuucaagcugaccuaccagaacaaggucgugaaggugcagcgccccacccccaccggcaccgucauggacaucaucucccggaaggaccagcgcggcagcggccaggugggcacguacgggcucaacaccuucaccaacauggaggcccagcugauccggcagauggagggcgagggggugcuguccaaggccgaccucgagaacccccaccucccggagaagaagaucacccaguggcuggagacgaagggcgucgagcgccucaagcggauggccaucagcggcgacgacugcguggugaagcccaucgacgaccgcuucgcgaacgcccugcuggcccucaacgacauggggaagguccggaaggacaucccccaguggcagcccuccaagggcuggcacgacuggcagcaggucccguucugcagccaccacuuccacgagcugaucaugaaggacgggcgcaagcuggugguccccugccggccccaggacgagcucaucggccgcgcccggaucucccagggggccggcuggagccugaaggagaccgcgugccugggcaaggccuacgcccagauguggucccucauguacuuccaccgccgcgaccugcggcuggccagcaacgcgaucugcuccgccgugcccgugcacugggucccgaccagccgcaccacguggagcauccacgcccaccaccaguggaugaccaccgaggacaugcucaccguguggaaccggguguggaucgaggacaaccccuggauggaggacaagacgcccgucaccaccugggagaacgugcccuaccuggggaagcgcgaggaccaguggugcggcucccugaucgggcucaccagccgggccacgugggcccagaacaucccgaccgcgauccagcagguccgcucccugaucggcaacgaggaguuccuggacuacaugcccagcaugaagcgguuccgcaaggaggaggaguccgagggggccaucugguga

SEQ ID NO: 9997 - RNA, 9873 nt, Artificial Sequence
  derived and/or modified CDS sequence (opt1) from DENV-3__FJ873813__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacaucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccggcguccugugggacgugcccagcccgcccgagacccagaaggccgagcuggaggaggggguguaccgcaucaagcagcagggcaucuucgggaagacccaggucggcgugggggugcagaaggagggcgucuuccacaccauguggcacgugacgcggggcgcggugcucaccuacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucguccgggaggcgaucaagcgccggcuccgcacccugauccuggcccccacccgggugguggccgccgagauggaggaggcccucaaggggcugcccauccgcuaccagaccacggcgaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggguacaucagcacccgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggaguucgccgcgggccgcaagagcaucgcccuggaccuggugaccgagaucgggcgggugcccucccaccucgcccaccgcacccggaacgcccuggacaaccuggucaugcuccacaccagcgagcacggcgggcgcgccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagaccaccaagcgggaccugggcauguccaaggagccggggguggugagccccacguccuaccuggacgucgaccuccaccccgccagcgccuggacccuguacgccguggcgaccaccgugaucacgcccaugcugcgccacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugacggccgccgugcuccugcugaucacccacuacgccaucaucggccccggccuccaggcgaaggccacccgggaggcccagaagcgcaccgccgccgggaucaugaagaacccgacggucgacggcaucaugaccaucgaccuggaccccgugaucuacgacuccaaguucgagaagcagcugggccaggugaugcuccugguccugugcgcggugcagcuccugcugaugcggaccagcugggcccucugcgaggcccugacccuggccacgggccccaucaccacccucugggagggcucccccgggaaguucuggaacaccacgaucgcggugagcauggccaacaucuuccgcggcuccuaccuggccggggccggccuggccuucagcaucaugaaguccgucgggaccggcaagcggggcaccgggagccagggcgagacccucggggagaaguggaagaagaagcugaaccagcugagccgcaaggacuucgaccucuacaagaaguccggcaucaccgagguggaccggacggaggcgaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccgcaccauccgcguccugaagaugguggagccguggcucaagaacaaccaguucugcaucaaggugcugaaccccuacaugcccacggucaucgagcaccuggagcggcuccagcgcaagcacggcgggaugcuggugcgguacccccugucccgcaacagcacccacgagauguacuggaucuccaacggcaccgggaacaucguggccagcgucaacauggugucccggcuccugcugaaccgcuucaccaugacgcaccggcgcccgaccaucgagaaggacguggaccucggcgcgggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgucgugcccauggugacgcagauggcgaugaccgacaccacccccuucgggcagcagcgcgucuucaaggagaagguggacacgcggaccccgcgcagcaugcccggcacccggcgcgugaugggcaucaccgccgaguggcucuggcggacgcuggggcgcaacaagaagccccggcugugcacccgcgaggaguucaccaagaagguccgcaccaacgccgccaugggcgcgguguucacggaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcccagcucauccggcagauggagggcgagggggugcugagcaaggccgaccuggagaacccccaccucccggagaagaagaucacccaguggcuggagacgaagggcgucgagcgccugaagcggauggcgaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggcgggcuggucccucaaggagaccgccugccugggcaaggccuacgcccagauguggagccugauguacuuccaccgccgcgaccuccggcuggcguccaacgccaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 9998 - RNA, 9873 nt, Artificial Sequence
  derived and/or modified CDS sequence (opt1) from DENV-3__FJ850048__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacaucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccggcguccugugggacgugcccagcccgcccgagacccagaaggccgagcuggaggaggggguguaccgcaucaagcagcagggcaucuucgggaagacccaggucggcgugggggugcagaaggagggcgucuuccacaccauguggcacgugacgcggggcgcggugcucaccuacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucguccgggaggcgaucaagcgccggcuccgcacccugauccuggcccccacccgggugguggccgccgagauggaggaggcccucaaggggcugcccauccgcuaccagaccacggcgaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggguacaucagcacccgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggaguucgccgcgggccgcaagagcaucgcccuggaccuggugaccgagaucgggcgggugcccucccaccucgcccaccgcacccggaacgcccuggacaaccuggucaugcuccacaccagcgagcacggcgggcgcgccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagaccaccaagcgggaccugggcauguccaaggagccggggguggugagccccacguccuaccuggacgucgaccuccaccccgccagcgccuggacccuguacgccguggcgaccaccgugaucacgcccaugcugcgccacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugacggccgccgugcuccugcugaucacccacuacgccaucaucggccccggccuccaggcgaaggccacccgggaggcccagaagcgcaccgccgccgggaucaugaagaacccgacggucgacggcaucaugaccaucgaccuggaccccgugaucuacgacuccaaguucgagaagcagcugggccaggugaugcuccugguccugugcgcggugcagcuccugcugaugcggaccagcugggcccucugcgaggcccugacccuggccacgggccccaucaccacccucugggagggcucccccgggaaguucuggaacaccacgaucgcggugagcauggccaacaucuuccgcggcuccuaccuggccggggccggccuggccuucagcaucaugaaguccgucgggaccggcaagcggggcaccgggagccagggcgagacccucggggagaaguggaagaagaagcugaaccagcugagccgcaaggacuucgaccucuacaagaaguccggcaucaccgagguggaccggacggaggcgaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccgcaccauccgcguccugaagaugguggagccguggcucaagaacaaccaguucugcaucaaggugcugaaccccuacaugcccacggucaucgagcaccuggagcggcuccagcgcaagcacggcgggaugcuggugcggaacccccugucccgcaacagcacccacgagauguacuggaucuccaacggcaccgggaacaucguggccagcgucaacauggugucccggcuccugcugaaccgcuucaccaugacgcaccggcgcccgaccaucgagaaggacguggaccucggcgcgggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgucgugcccauggugacgcagauggcgaugaccgacaccacccccuucgggcagcagcgcgucuucaaggagaagguggacacgcggaccccgcgcagcaugcccggcacccggcgcgugaugggcaucaccgccgaguggcucuggcggacgcuggggcgcaacaagaagccccggcugugcacccgcgaggaguucaccaagaagguccgcaccaacgccgccaugggcgcgguguucacggaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcccagcucauccggcagauggagggcgagggggugcugagcaaggccgaccuggagaacccccaccucccggagaagaagaucacccaguggcuggagacgaagggcgucgagcgccugaagcggauggcgaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggcgggcuggucccucaaggagaccgccugccugggcaaggccuacgcccagauguggagccugauguacuuccaccgccgcgaccuccggcuggcguccaacgccaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 9999 - RNA, 9873 nt, Artificial Sequence
  derived and/or modified CDS sequence (opt1) from DENV-3__FJ850049__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccgaugugccaguccagcuccaugcggaagaccgacuggcuccccauggcggucgccgccaugggcgugccgccccucccgcuguucaucuucagccucaaggacacgcugaagcgccgcuccuggccccugaacgagggggugauggccgucggccucgugagcauccuggccuccagccugcuccggaacgacgugcccauggcgggcccccuggucgccgggggccugcucaucgccugcuacgugaucaccgggaccuccgccgaccugaccguggagaaggccgcgaacaucacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccgggucguggccgccgagauggaggaggcccucaaggggcugcccauccgcuaccagaccacggcgaccaaguccgagcacaccggccgggagaucguggaccugaugugccacgccaccuucacgaugcgccuccugagccccguccgggugccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgucugguucgugcccagcaucaaggcgggcaacgacaucgccaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggaguucgccgcgggccgcaagagcaucgcccuggaccuggucaccgagaucgggcgggugcccucccaccucgcccaccgcacccggaacgcccuggacaaccuggugaugcuccacaccagcgagcacggcgggcgcgccuaccggcacgcggucgaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcgcacgccccaggacaaccagcuggccuacguggugaucgggauccucacccuggccgccaucaucgccgcgaacgagaugggccugcucgagaccaccaagcgggaccugggcauguccaaggagccgggggucgugagccccacguccuaccuggacguggaccuccaccccgccagcgccuggacccuguacgccgucgcgaccaccgugaucacgcccaugcugcgccacaccaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugacggccgccgugcuccugcugaucacccacuacgccaucaucggccccggccuccaggcgaaggccacccgggaggcccagaagcgcaccgccgccgggaucaugaagaacccgacgguggacggcaucaugaccaucgaccuggaccccgucaucuacgacuccaaguucgagaagcagcugggccaggugaugcuccuggugcugugcgcgguccagcuccugcugaugcggaccagcugggcccucugcgaggcccugacccuggccacgggccccaucaccacccucugggagggcucccccgggaaguucuggaacaccacgaucgcggugagcauggccaacaucuuccgcggcuccuaccuggccggggccggccuggccuucagcaucaugaaguccguggggaccggcaagcggggcaccgggagccagggcgagacccucggggagaaguggaagaagaagcugaaccagcugagccgcaaggacuucgaccucuacaagaaguccggcaucaccgaggucgaccggacggaggcgaaggaggggcugaagcgcggcgagaucacccaccacgccgugagccggggcuccgccaagcugcagugguucguggagcgcaacauggucaucccggaggggcgggugaucgaccucggcugcgggcgcggcggguggagcuacuacugcgccggccugaagaaggugaccgagguccggggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccgcaccauccgcgugcugaagauggucgagccguggcucaagaacaaccaguucugcaucaaggugcugaaccccuacaugcccacggugaucgagcaccuggagcggcuccagcgcaagcacggcgggaugcugguccggaacccccugucccgcaacagcacccacgagauguacuggaucuccaacggcaccgggaacaucguggccagcgugaacauggucucccggcuccugcugaaccgcuucaccaugacgcaccggcgcccgaccaucgagaaggacguggaccucggcgcgggcacccggcacgugaacgccgagcccgagacccccaacauggacgucaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcguggucaagcugcugaccaagcccugggacgugguccccauggugacgcagauggcgaugaccgacaccacccccuucgggcagcagcgcguguucaaggagaaggucgacacgcggaccccgcgcagcaugcccggcacccggcgcgugaugggcaucaccgccgaguggcucuggcggacgcuggggcgcaacaagaagccccggcugugcacccgcgaggaguucaccaagaaggugcgcaccaacgccgccaugggcgcggucuucacggaggagaaccagugggacuccgccaaggccgccguggaggacgaggacuucuggaagcucguggaccgggagcgcgagcugcacaagcuggggaagugcggcagcugcgucuacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaagguggucaaggugcagcgccccacccccaccggcaccgugauggacaucaucagccggaaggaccagcgcggcuccgggcaggucggcacguacgggcugaacaccuucaccaacauggaggcccagcucauccggcagauggagggcgagggggugcugagcaaggccgaccuggagaacccccaccucccggagaagaagaucacccaguggcuggagacgaagggcguggagcgccugaagcggauggcgaucuccggcgacgacugcgucgugaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcccggaucagccagggggcgggcuggucccucaaggagaccgccugccugggcaaggccuacgcccagauguggagccugauguacuuccaccgccgcgaccuccggcuggcguccaacgccaucugcagcgccguccccgugcacugggugccgaccucccgcaccacguggagcauccacgcccaccaccaguggaugaccaccgaggacaugcugaccgucuggaaccggguguggaucgaggacaaccccuggauggaggacaagacgcccgugaccaccugggagaacguccccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10000 - RNA, 9873 nt, Artificial Sequence
  derived and/or modified CDS sequence (opt1) from DENV-3__FJ898476__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucgggcucaaggacacgcugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugaccgucgagaaggccgcggacaucacgugggaggaggaggccgagcagaccggggugucccacaaccugaugaucaccguggacgacgacggcaccaugcgcaucaaggacgacgagaccgagaacauccucacgguccugcugaagaccgcccuccugaucgugagcggcaucuucccguacuccauccccgccacccugcucguguggcacaccuggcagaagcagacgcagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacaccauguggcacgugacgcgcggggcggugcucaccuacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggaccuuccagacgaccaccggcgagaucggggcgaucgcccuggacuucaagcccggcaccuccggcagccccaucaucaaccgcgaggggaagguggugggccuguacgggaacggcgucgugacgaagaacgggggcuacgugagcggcaucgcccagaccaacgccgagccggacgggcccacccccgagcuggaggaggagauguucaagaagcggaaccucaccaucauggaccugcaccccggcuccgggaagacgcgcaaguaccugccggccaucguccgggaggcgaucaagcgccggcuccgcacccugauccuggcccccacccgggugguggccgccgagauggaggaggcccucaagggccugcccauccgcuaccagaccacggcgaccaagagcgagcacaccgggcgggagaucgucgaccugaugugccacgccaccuucacgaugcgccuccugucccccgugcgggugccgaacuacaaccugaucaucauggacgaggcccacuucaccgaccccgccagcaucgccgcgcgcggcuacaucuccacccgggucggcaugggggaggccgccgccaucuucaugaccgcgacgccgcccggcaccgccgacgccuucccgcagagcaacgcccccauccaggacgaggagcgcgacauccccgagcgcuccuggaacagcgggaacgaguggaucaccgacuucgccggcaagaccgugugguucgugcccuccaucaaggcggggaacgacaucgccaacugccuccggaagaacggcaagaaggucauccagcugagccgcaagacguucgacaccgaguaccagaagaccaagcugaacgacugggacuucguggugaccacggacaucuccgagaugggcgccaacuucaaggccgaccgggucaucgacccgcgccggugccucaagcccgugauccugaccgacgggcccgagcgcgugauccuggccggccccaugccggucaccgcggccagcgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacgcccgagggcaucaucccggcccucuucgagcccgagcgggagaaguccgccgccaucgacggcgaguaccgccugaagggggagagccggaagaccuucguggagcugaugcgccggggcgaccuccccgucuggcuggcgcacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcacguacagcgacccgcuggcccucaaggaguucaaggaguucgccgcggggcgcaaguccaucgcccuggaccuggugaccgagaucggccgggugcccagccaccucgcccaccgcacccggaacgcccuggacaaccuggucaugcuccacaccuccgagcacgggggccgcgccuaccggcacgcgguggaggagcugcccgagacgauggagacccugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgccuccgcgaucguccuggaguucuucaugauggugcuccugauccccgagcccgagaagcagcgcacgccccaggacaaccagcuggccuacguggucaucggcauccucacccuggccgccaucaucgccgcgaacgagaugggccugcucgagaccaccaagcgggaccuggggaugagcaaggagccgggcguggugucccccacgagcuaccuggacgucgaccuccaccccgccuccgccuggacccuguacgccguggcgaccaccgugaucacgcccaugcugcgccacaccaucgagaacagcaccgccaacgucucccucgccgccaucgccaaccaggcgguggugcugauggggcuggacaagggcuggccgaucagcaagauggaccucggggucccccugcuggcccucggcugcuacucccaggugaacccccugacccugacggccgccgugcuccugcugaucacccacuacgccaucaucggccccgggcuccaggcgaaggccacccgggaggcccagaagcgcaccgccgccggcaucaugaagaacccgacggucgacgggaucaugaccaucgaccuggaccccgugaucuacgacagcaaguucgagaagcagcugggccaggugaugcuccugguccugugcgcggugcagcuccugcugaugcggaccuccugggcccucugcgaggcccugacccuggccacgggccccaucaccacccucugggaggggagccccggcaaguucuggaacaccacgaucgcgguguccauggccaacaucuuccgcgggagcuaccuggccggcgccgggcuggccuucuccaucaugaaguccgucggcaccggcaagcgggggaccggcucccagggggagacccucggcgagaaguggaagaagaagcugaaccagcugagccgcaaggacuucgaccucuacaagaaguccgggaucaccgagguggaccggacggaggcgaaggagggccugaagcgcggcgagaucacccaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacaccaagggcgggcccggccacgaggagcccgugcccaugagcacguacggguggaacaucgucaagcugauguccggcaaggacguguucuaccucccgcccgagaagugcgacacccugcugugcgacaucggcgagagcucccccagccccaccguggaggagucccgcaccauccgcguccugaagaugguggagccguggcucaagaacaaccaguucugcaucaaggugcugaaccccuacaugcccacggucaucgagcaccuggagcggcuccagcgcaagcacgggggcaugcuggugcggaacccccugagccgcaacuccacccacgagauguacuggaucagcaacgggaccggcaacaucguggccuccgucaacauggugagccggcuccugcugaaccgcuucaccaugacgcaccggcgcccgaccaucgagaaggacguggaccucggcgcggggacccggcacgucaacgccgagcccgagacccccaacauggacgugaucggcgagcgcaucaagcggaucaaggaggagcacaacuccacguggcacuacgacgacgagaacccguacaagaccugggccuaccacgggagcuacgaggugaaggccaccggcuccgccagcuccaugaucaacggggucgugaagcugcugaccaagcccugggacgucgugcccauggugacgcagauggcgaugaccgacaccacccccuucggccagcagcgcgucuucaaggagaagguggacacgcggaccccgcgcagcaugcccggcacccggcgcgugauggggaucaccgccgaguggcucuggcggacgcugggccgcaacaagaagccccggcugugcacccgcgaggaguucaccaagaagguccgcaccaacgccgccaugggggcgguguucacggaggagaaccagugggacagcgccaaggccgccguggaggacgaggacuucuggaagcucgucgaccgggagcgcgagcugcacaagcugggcaagugcggguccugcguguacaacaugaugggcaagcgggagaagaagcucggcgaguucgggaaggccaagggcagccgcgcgaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgccgacgacaccgcgggcugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucucccggaaggaccagcgcgggagcggccagguggggacguacggccugaacaccuucaccaacauggaggcccagcucauccggcagauggagggggagggcgugcuguccaaggccgaccuggagaacccccaccucccggagaagaagaucacccaguggcuggagacgaagggcgucgagcgccugaagcggauggcgaucagcggggacgacugcguggugaagcccaucgacgaccgcuucgccaacgcccuccuggcccugaacgacaugggcaagguccggaaggacaucccccaguggcagcccuccaagggguggcacgacuggcagcaggucccguucugcagccaccacuuccacgagcucaucaugaaggacggccgcaagcuggugguccccugccggccccaggacgagcugaucgggcgcgcccggaucucccagggcgcgggcuggagccucaaggagaccgccugccuggggaaggccuacgcccagauguggucccugauguacuuccaccgccgcgaccuccggcuggcgagcaacgccaucugcuccgccgugcccgugcacugggucccgaccagccgcaccacgugguccauccacgcccaccaccaguggaugaccaccgaggacaugcugaccguguggaaccggguguggaucgaggacaaccccuggauggaggacaagacgcccgucaccaccugggagaacgugcccuaccucggcaagcgcgaggaccaguggugcgggagccugaucggccugaccagccgggccacgugggcgcagaacaucccgaccgccauccagcagguccgcucccucaucgggaacgaggaguuccuggacuacaugcccagcaugaagcgguuccgcaaggaggaggaguccgagggcgccaucugguga

SEQ ID NO: 10001 - RNA, 9873 nt, Artificial Sequence
  derived and/or modified CDS sequence (opt1) from DENV-3__FJ898475__SS-prME
accagccugugccucaugaugauccugcccgccgcccuggcguuccaccucaccagccgggacggggagccgcggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguuccugaccuucguccuccugcuguccggccagaucaccuggcgcgacauggcgcacacgcucaucaugaucggcagcaacgccuccgaccggauggggaugggcgugaccuaccuggcccugaucgccaccuucaagauccagcccuuccucgcccugggguucuuccugcgcaagcucaccagccgggagaaccugcugcucggcgugggccuggcgauggccacgacccugcagcuccccgaggacaucgagcagauggccaacgggaucgcccugggccugauggcgcucaagcugaucacccaguucgagaccuaccagcuguggacggcccucaucagccugaccugcuccaacaccaucuucacccugacggucgccuggcgcaccgccacccucauccuggccggggugagccugcucccggucugccaguccagcuccaugcggaagaccgacuggcugcccauggcgguggccgccaugggcgugccgccccugccccuguucaucuucagccugaaggacacgcugaagcgccgcuccuggccccucaacgagggggucauggccgugggccuggugagcauccuggccuccagccuccugcggaacgacguccccauggcgggcccccugguggccgggggccuccugaucgccugcuacgugaucaccgggaccuccgccgaccugaccgucgagaaggccgcggacaucacgugggaggaggaggccgagcagaccggcgugagccacaaccucaugaucaccguggacgacgacgggaccaugcgcaucaaggacgacgagaccgagaacauccugacgguccugcucaagaccgcccugcugaucguguccggcaucuucccguacagcauccccgccacccuccugguguggcacaccuggcagaagcagacgcagcgguccggcguccugugggacgugcccagcccgcccgagacccagaaggccgagcucgaggaggggguguaccgcaucaagcagcagggcaucuucgggaagacccaggucggcgugggggugcagaaggagggcgucuuccacaccauguggcacgugacgcggggcgcggugcugaccuacaacgggaagcgccuggagcccaacugggccuccgucaagaaggaccucaucagcuacggcgggggcuggcggcuguccgcccaguggcagaagggggaggagguccaggugaucgccgucgagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcucgaggaggagauguucaagaagcggaaccugaccaucauggaccugcaccccgggagcggcaagacgcgcaaguaccucccggccaucguccgggaggcgaucaagcgccggcugcgcacccugauccucgcccccacccgggugguggccgccgagauggaggaggcccugaaggggcugcccauccgcuaccagaccacggcgaccaaguccgagcacaccggccgggagaucgucgaccucaugugccacgccaccuucacgaugcgccugcugagccccgugcgggugccgaacuacaaccucaucaucauggacgaggcccacuucaccgaccccgccuccaucgccgcgcgcggguacaucagcacccgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccugcggaagaacgggaagaaggucauccagcugucccgcaagacguucgacaccgaguaccagaagaccaagcucaacgacugggacuucguggugaccacggacaucagcgagaugggcgccaacuucaaggccgaccgggucaucgacccgcgccggugccugaagcccgugauccugaccgacggccccgagcgcgugauccucgccgggcccaugccggucaccgcggccuccgccgcccagcggcgcggccggguggggcgcaacccccagaaggagaacgaccaguacaucuucaccggccagccccugaacaacgacgaggaccacgcccacuggaccgaggcgaagaugcugcucgacaacaucaacacgcccgaggggaucaucccggcccuguucgagcccgagcgggagaaguccgccgccaucgacggcgaguaccgccugaagggcgagucccggaagaccuucguggagcucaugcgccgcggggaccugcccgucuggcuggcgcacaagguggccagcgagggcaucaaguacaccgaccgcaaguggugcuucgacgggcagcggaacaaccagauccucgaggagaacauggacgucgagaucuggaccaaggagggcgagaagaagaagcugcgcccccgguggcuggacgcccgcacguacuccgacccgcucgcccugaaggaguucaaggaguucgccgcgggccgcaagagcaucgcccuggaccucgugaccgagaucgggcgggugcccucccaccuggcccaccgcacccggaacgcccuggacaaccucgucaugcugcacaccagcgagcacggcgggcgcgccuaccggcacgcgguggaggagcugcccgagacgauggagacccuccugcugcucggccugaugauccugcucaccgggggcgccaugcuguuccugaucagcggcaaggggaucggcaagaccuccaucgggcucaucugcgugaucgccagcuccggcaugcuguggauggccgagaucccgcugcaguggaucgccagcgcgaucguccucgaguucuucaugauggugcugcugauccccgagcccgagaagcagcgcacgccccaggacaaccagcucgccuacguggucaucgggauccugacccuggccgccaucaucgccgcgaacgagaugggccuccuggagaccaccaagcgggaccugggcauguccaaggagccggggguggugagccccacguccuaccucgacgucgaccugcaccccgccagcgccuggacccuguacgccguggcgaccaccgugaucacgcccaugcuccgccacaccaucgagaacuccaccgccaacgucagccuggccgccaucgccaaccaggcgguggugcugaugggccucgacaagggguggccgaucuccaagauggaccugggcgucccccugcucgcccuggggugcuacagccaggugaacccccugacccucacggccgccgugcugcugcucaucacccacuacgccaucaucggccccggccugcaggcgaaggccacccgggaggcccagaagcgcaccgccgccgggaucaugaagaacccgacggucgacggcaucaugaccaucgaccuggaccccgugaucuacgacuccaaguucgagaagcagcucggccaggugaugcugcugguccucugcgcggugcagcugcugcucaugcggaccagcugggcccugugcgaggcccugacccucgccacgggccccaucaccacccugugggagggcucccccgggaaguucuggaacaccacgaucgcggugagcauggccaacaucuuccgcggcuccuaccuggccggggccggccucgccuucagcaucaugaaguccgucgggaccggcaagcggggcaccgggagccagggcgagacccugggggagaaguggaagaagaagcugaaccagcucagccgcaaggacuucgaccuguacaagaaguccggcaucaccgagguggaccggacggaggcgaaggaggggcugaagcgcggcgagaucacccaccacgccgugagccggggcuccgccaagcuccagugguucgucgagcgcaacauggugaucccggaggggcgggugaucgaccugggcugcgggcgcggcggguggagcuacuacugcgccggccugaagaaggucaccgaggugcggggcuacaccaagggcgggcccgggcacgaggagcccgugcccauguccacguacggcuggaacaucgucaagcucaugagcgggaaggacguguucuaccugccgcccgagaagugcgacacccugcugugcgacaucggcgaguccagccccucccccaccguggaggagagccgcaccauccgcguccucaagaugguggagccguggcugaagaacaaccaguucugcaucaaggugcugaaccccuacaugcccacggucaucgagcaccucgagcggcugcagcgcaagcacggcgggaugcuggugcggaacccccucucccgcaacagcacccacgagauguacuggaucuccaacggcaccgggaacaucguggccagcgucaacauggugucccggcugcugcucaaccgcuucaccaugacgcaccggcgcccgaccaucgagaaggacguggaccugggcgcgggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcugcucaccaagcccugggacgucgugcccauggugacgcagauggcgaugaccgacaccacccccuucgggcagcagcgcgucuucaaggagaagguggacacgcggaccccgcgcagcaugcccggcacccggcgcgugaugggcaucaccgccgaguggcuguggcggacgcuggggcgcaacaagaagccccggcucugcacccgcgaggaguucaccaagaagguccgcaccaacgccgccaugggcgcgguguucacggaggagaaccagugggacuccgccaaggccgccguggaggacgaggacuucuggaagcuggucgaccgggagcgcgagcugcacaagcucgggaagugcggcagcugcguguacaacaugauggggaagcgggagaagaagcugggcgaguucggcaaggccaaggggucccgcgcgaucugguacauguggcugggcgcccgguaccucgaguucgaggcccugggguuccugaacgaggaccacugguucagccgcgagaacuccuacagcggcguggagggggagggccuccacaagcugggcuacauccugcgggacaucuccaagauccccgggggcgccauguacgccgacgacaccgcggggugggacacccgcaucaccgaggacgaccuccacaacgaggagaagaucacgcagcagauggacccggagcaccggcagcuggccaacgccaucuucaagcugaccuaccagaacaaggucgugaaggugcagcgccccacccccaccggcaccgucauggacaucaucagccggaaggaccagcgcggcuccggccaggugggcacguacgggcucaacaccuucaccaacauggaggcccagcugauccggcagauggagggcgagggggugcugagcaaggccgaccucgagaacccccaccucccggagaagaagaucacccaguggcuggagacgaagggcgucgagcgccucaagcggauggcgaucuccggcgacgacugcguggugaagcccaucgacgaccgcuucgccaacgcccugcuggcccucaacgacauggggaagguccggaaggacaucccccaguggcagcccagcaagggcuggcacgacuggcagcaggucccguucugcucccaccacuuccacgagcugaucaugaaggacgggcgcaagcuggugguccccugccggccccaggacgagcucaucggccgcgcccggaucagccagggggcgggcuggucccugaaggagaccgccugccugggcaaggccuacgcccagauguggagccucauguacuuccaccgccgcgaccugcggcuggcguccaacgccaucugcagcgccgugcccgugcacugggucccgaccucccgcaccacguggagcauccacgcccaccaccaguggaugaccaccgaggacaugcucaccguguggaaccggguguggaucgaggacaaccccuggauggaggacaagacgcccgucaccaccugggagaacgugcccuaccuggggaagcgcgaggaccaguggugcggcagccugaucgggcucaccucccgggccacgugggcgcagaacaucccgaccgccauccagcagguccgcagccugaucggcaacgaggaguuccuggacuacaugcccuccaugaagcgguuccgcaaggaggaggagagcgagggggccaucugguga

SEQ ID NO: 10002 - RNA, 9873 nt, Artificial Sequence
  derived and/or modified CDS sequence (opt1) from DENV-3__GQ199861__SS-prME
accagccucugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccgaugugccaguccagcuccaugcggaagaccgacuggcuccccauggcggucgccgccaugggcgugccgccccucccgcuguucaucuucagccucaaggacacgcugaagcgccgcuccuggccccugaacgagggggugauggccgucggccucgugagcauccuggccuccagccugcuccggaacgacgugcccauggcgggcccccuggucgccgggggccugcucaucgccugcuacgugaucaccgggaccuccgccgaccugaccguggagaaggccgcggacaucacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgcggugcucaccuacaacgggaagcgccuggagcccaacugggccaacgugaagaaggaccugaucuccuacggcgggggcuggcggcucagcgcccaguggcagaagggggaggagguccaggugaucgccguggagcccggcaagaaccccaagaacuuccagaccaugcccggcaccuuccagacgaccaccggggagaucggcgcgaucgcccuggacuucaagcccgggaccuccggcagccccaucaucaaccgcgagggcaaggucguggggcuguacggcaacgggguggucacgaagaacggcggguacgugagcggcaucgcccagaccaacgccgagccggacggccccacccccgagcuggaggaggagauguucaagaagcggaaccucaccaucauggaccugcaccccggguccggcaagacgcgcaaguaccugccggccaucgugcgggaggcgaucaagcgccggcuccgcacccugauccuggcccccacccgggucguggccgccgagauggaggaggcccucaaggggcugcccauccgcuaccagaccacggcgaccaagagcgagcacaccggccgggagaucguggaccugaugugccacgccaccuucacgaugcgccuccugucccccguccgggugccgaacuacaaccugaucaucauggacgaggcccacuucaccgaccccgccagcaucgccgcgcgcggguacaucuccacccgggugggcaugggcgaggccgccgccaucuucaugaccgcgacgccgcccgggaccgccgacgccuucccgcagagcaacgcccccauccaggacgaggagcgcgacauccccgagcgcuccuggaacagcggcaacgaguggaucaccgacuucgccgggaagaccgucugguucgugcccuccaucaaggcgggcaacgacaucgccaacugccuccggaagaacgggaagaaggugauccagcugagccgcaagacguucgacaccgaguaccagaagaccaagcugaacgacugggacuucgucgugaccacggacaucuccgagaugggcgccaacuucaaggccgaccgggugaucgacccgcgccggugccucaagcccgucauccugaccgacggccccgagcgcgugauccuggccgggcccaugccggugaccgcggccagcgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagagccggaagaccuucguggagcugaugcgccgcggggaccuccccguguggcuggcgcacaaggucgccuccgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacagcgacccgcuggcccucaaggaguucaaggaguucgccgcgggccgcaaguccaucgcccuggaccuggucaccgagaucgggcgggugcccagccaccucgcccaccgcacccggaacgcccuggacaaccuggugaugcuccacaccuccgagcacggcgggcgcgccuaccggcacgcggucgaggagcugcccgagacgauggagacccugcuccugcugggccucaugauccugcugaccgggggcgccaugcuguuccugaucagcggcaaggggaucggcaagaccagcaucgggcugaucugcgugaucgccuccagcggcaugcucuggauggccgagaucccgcugcaguggaucgccuccgcgaucgugcuggaguucuucaugaugguccuccugauccccgagcccgagaagcagcgcacgccccaggacaaccagcuggccuacguggugaucgggauccucacccuggccgccaucaucgccgcgaacgagaugggccugcucgagaccaccaagcgggaccugggcaugagcaaggagccgggggucgugucccccacgagcuaccuggacguggaccuccaccccgccuccgccuggacccuguacgccgucgcgaccaccgugaucacgcccaugcugcgccacaccaucgagaacagcaccgccaacgugucccucgccgccaucgccaaccaggcggucgugcugaugggccuggacaagggguggccgaucagcaagauggaccucggcgugccccugcuggcccucgggugcuacucccaggucaacccccugacccugacggccgccgugcuccugcugaucacccacuacgccaucaucggccccggccuccaggcgaaggccacccgggaggcccagaagcgcaccgccgccgggaucaugaagaacccgacgguggacggcaucaugaccaucgaccuggaccccgucaucuacgacagcaaguucgagaagcagcugggccaggugaugcuccuggugcugugcgcgguccagcuccugcugaugcggaccuccugggcccucugcgaggcccugacccuggccacgggccccaucaccacccucugggagggcagccccgggaaguucuggaacaccacgaucgcgguguccauggccaacaucuuccgcggcagcuaccuggccggggccggccuggccuucuccaucaugaaguccguggggaccggcaagcggggcaccgggucccagggcgagacccucggggagaaguggaagaagaagcugaaccagcugagccgcaaggacuucgaccucuacaagaaguccggcaucaccgaggucgaccggacggaggcgaaggaggggcugaagcgcggcgagaucacccaccacgccgugucccggggcagcgccaagcugcagugguucguggagcgcaacauggucaucccggaggggcgggugaucgaccucggcugcgggcgcggcgggugguccuacuacugcgccggccugaagaaggugaccgagguccggggcuacaccaagggcgggcccgggcacgaggagcccgugcccaugagcacguacggcuggaacaucgugaagcugauguccgggaaggacgucuucuaccucccgcccgagaagugcgacacccugcugugcgacaucggcgagagcucccccagccccaccguggaggagucccgcaccauccgcgugcugaagauggucgagccguggcucaagaacaaccaguucugcaucaaggugcugaaccccuacaugcccacggugaucgagcaccuggagcggcuccagcgcaagcacggcgggaugcugguccggaacccccugagccgcaacuccacccacgagauguacuggaucagcaacggcaccgggaacaucguggccuccgugaacauggucagccggcuccugcugaaccgcuucaccaugacgcaccggcgcccgaccaucgagaaggacguggaccucggcgcgggcacccggcacgugaacgccgagcccgagacccccaacauggacgucaucggggagcgcaucaagcggaucaaggaggagcacaacuccacguggcacuacgacgacgagaacccguacaagaccugggccuaccacggcagcuacgaggugaaggccaccggguccgccagcuccaugaucaacggcguggucaagcugcugaccaagcccugggacgugguccccauggugacgcagauggcgaugaccgacaccacccccuucgggcagcagcgcguguucaaggagaaggucgacacgcggaccccgcgcagcaugcccggcacccggcgcgugaugggcaucaccgccgaguggcucuggcggacgcuggggcgcaacaagaagccccggcugugcacccgcgaggaguucaccaagaaggugcgcaccaacgccgccaugggcgcggucuucacggaggagaaccagugggacagcgccaaggccgccguggaggacgaggacuucuggaagcucguggaccgggagcgcgagcugcacaagcuggggaagugcggcuccugcgucuacaacaugauggggaagcgggagaagaagcucggcgaguucggcaaggccaaggggagccgcgcgaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaagguggucaaggugcagcgccccacccccaccggcaccgugauggacaucaucucccggaaggaccagcgcggcagcgggcaggucggcacguacgggcugaacaccuucaccaacauggaggcccagcucauccggcagauggagggcgagggggugcuguccaaggccgaccuggagaacccccaccucccggagaagaagaucacccaguggcuggagacgaagggcguggagcgccugaagcggauggcgaucagcggcgacgacugcgucgugaagcccaucgacgaccgcuucgccaacgcccuccuggcccugaacgacauggggaaggugcggaaggacaucccccaguggcagcccuccaagggcuggcacgacuggcagcaggucccguucugcagccaccacuuccacgagcucaucaugaaggacgggcgcaagcugguggugcccugccggccccaggacgagcugaucggccgcgcccggaucucccagggggcgggcuggagccucaaggagaccgccugccugggcaaggccuacgcccagauguggucccugauguacuuccaccgccgcgaccuccggcuggcgagcaacgccaucugcuccgccguccccgugcacugggugccgaccagccgcaccacgugguccauccacgcccaccaccaguggaugaccaccgaggacaugcugaccgucuggaaccggguguggaucgaggacaaccccuggauggaggacaagacgcccgugaccaccugggagaacguccccuaccucgggaagcgcgaggaccaguggugcggcagccugaucgggcugaccagccgggccacgugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10003 - RNA, 9873 nt, Artificial Sequence
  derived and/or modified CDS sequence (opt1) from DENV-3__GQ199862__SS-prME
accagccugugccucaugaugauccugcccgccgcccuggcguuccaccucaccagccgggacggggagccgcggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacaucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccggcguccugugggacgugcccagcccgcccgagacccagaaggccgagcuggaggaggggguguaccgcaucaagcagcagggcauccucgggaagacccaggucggcgugggggugcagaaggagggcgucuuccacaccauguggcacgugacgcggggcgcggugcugaccuacaacgggaagcgccuggagcccaacugggccuccgucaagaaggaccucaucagcuacggcgggggcuggcggcuguccgcccaguggcagaagggggaggagguccaggugaucgccgucgagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcucgaggaggagauguucaagaagcggaaccugaccaucauggaccugcaccccgggagcggcaagacgcgcaaguaccucccggccaucguccgggaggcgaucaagcgccggcugcgcacccugauccucgcccccacccgggugguggccgccgagauggaggaggcccugaaggggcugcccauccgcuaccagaccacggcgaccaaguccgagcacaccggccgggagaucgucgaccucaugugccacgccaccuucacgaugcgccugcugagccccgugcgggugccgaacuacaaccucaucaucauggacgaggcccacuucaccgaccccgccuccaucgccgcgcgcggguacaucagcacccgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccugcggaagaacgggaagaaggucauccagcugucccgcaagacguucgacaccgaguaccagaagaccaagcucaacgacugggacuucguggugaccacggacaucagcgagaugggcgccaacuucaaggccgaccgggucaucgacccgcgccggugccugaagcccgugauccugaccgacggccccgagcgcgugauccucgccgggcccaugccggucaccgcggccuccgccgcccagcggcgcggccggguggggcgcaacccccagaaggagaacgaccaguacaucuucaccggccagccccugaacaacgacgaggaccacgcccacuggaccgaggcgaagaugcugcucgacaacaucaacacgcccgaggggaucaucccggcccuguucgagcccgagcgggagaaguccgccgccaucgacggcgaguaccgccugaagggcgagucccggaagaccuucguggagcucaugcgccgcggggaccugcccgucuggcuggcgcacaagguggccagcgagggcaucaaguacaccgaccgcaaguggugcuucgacgggcagcggaacaaccagauccucgaggagaacauggacgucgagaucuggaccaaggagggcgagaagaagaagcugcgcccccgguggcuggacgcccgcacguacuccgacccgcucgcccugaaggaguucaaggaguucgccgcgggccgcaagagcaucgcccuggaccucgugaccgagaucgggcgggugcccucccaccuggcccaccgcacccggaacgcccuggacaaccucgucaugcugcacaccagcgagcacggcgggcgcgccuaccggcacgcgguggaggagcugcccgagacgauggagacccuccugcugcucggccugaugauccugcucaccgggggcgccaugcuguuccugaucagcggcaaggggaucggcaagaccuccaucgggcucaucugcgugaucgccagcuccggcaugcuguggauggccgagaucccgcugcaguggaucgccagcgcgaucguccucgaguucuucaugauggugcugcugauccccgagcccgagaagcagcgcacgccccaggacaaccagcucgccuacguggucaucgggauccugacccuggccgccaucaucgccgcgaacgagaugggccuccuggagaccaccaagcgggaccugggcauguccaaggagccggggguggugagccccacguccuaccucgacgucgaccugcaccccgccagcgccuggacccuguacgccguggcgaccaccgugaucacgcccaugcuccgccacaccaucgagaacuccaccgccaacgucagccuggccgccaucgccaaccaggcgguggugcugaugggccucgacaagggguggccgaucuccaagauggaccugggcgucccccugcucgcccuggggugcuacagccaggugaacccccugacccucacggccgccgugcugcugcucaucacccacuacgccaucaucggccccggccugcaggcgaaggccacccgggaggcccagaagcgcaccgccgccgggaucaugaagaacccgacggucgacggcaucaugaccaucgaccuggaccccgugaucuacgacuccaaguucgagaagcagcucggccaggugaugcugcugguccucugcgcggugcagcugcugcucaugcggaccagcugggcccugugcgaggcccugacccucgccacgggccccgugaccacccugugggagggcucccccgggaaguucuggaacaccacgaucgcggucagcauggccaacaucuuccgcggcuccuaccuggccggggccggccucgccuucagcaucaugaaguccguggggaccggcaagcggggcaccgggagccagggcgagacccugggggagaaguggaagaagaagcugaaccagcucagccgcaaggacuucgaccuguacaagaaguccggcaucaccgagguggaccggacggaggcgaaggaggggcugaagcgcggcgagaucacccaccacgccgucagccggggcuccgccaagcuccagugguucguggagcgcaacauggugaucccggaggggcgggucaucgaccugggcugcgggcgcggcggguggagcuacuacugcgccggccugaagaaggugaccgaggugcggggcuacaccaagggcgggcccgggcacgaggagcccguccccauguccacguacggcuggaacaucgugaagcucaugagcgggaaggacguguucuaccugccgcccgagaagugcgacacccugcugugcgacaucggcgaguccagccccucccccaccgucgaggagagccgcaccauccgcgugcucaagaugguggagccguggcugaagaacaaccaguucugcaucaagguccugaaccccuacaugcccacggugaucgagcaccucgagcggcugcagcgcaagcacggcgggaugcuggugcggaacccccucucccgcaacagcacccacgagauguacuggaucuccaacggcaccgggaacaucgucgccagcgugaacauggugucccggcugcugcucaaccgcuucaccaugacgcaccggcgcccgaccaucgagaaggacgucgaccugggcgcgggcacccggcacgugaacgccgagcccgagacccccaacauggacgugaucggggagcgcaucaagcggaucaaggaggagcacaacagcacguggcacuacgacgacgagaacccguacaagaccugggccuaccacggcuccuacgaggucaaggccaccgggagcgccuccagcaugaucaacggcguggucaagcugcucaccaagcccugggacguggugcccauggucacgcagauggcgaugaccgacaccacccccuucgggcagcagcgcguguucaaggagaagguggacacgcggaccccgcgcagcaugcccggcacccggcgcgucaugggcaucaccgccgaguggcuguggcggacgcuggggcgcaacaagaagccccggcucugcacccgcgaggaguucaccaagaaggugcgcaccaacgccgccaugggcgcgguguucacggaggagaaccagugggacuccgccaaggccgccgucgaggacgaggacuucuggaagcugguggaccgggagcgcgagcugcacaagcucgggaagugcggcagcugcguguacaacaugauggggaagcgggagaagaagcugggcgaguucggcaaggccaaggggucccgcgcgaucugguacauguggcugggcgcccgguaccucgaguucgaggcccugggguuccugaacgaggaccacugguucagccgcgagaacuccuacagcggcgucgagggggagggccuccacaagcugggcuacauccugcgggacaucuccaagauccccgggggcgccauguacgccgacgacaccgcggggugggacacccgcaucaccgaggacgaccuccacaacgaggagaagaucacgcagcagauggacccggagcaccggcagcuggccaacgccaucuucaagcugaccuaccagaacaagguggugaagguccagcgccccacccccaccggcaccgugauggacaucaucagccggaaggaccagcgcggcuccggccaggugggcacguacgggcucaacaccuucaccaacauggaggcccagcugauccggcagauggagggcgaggggguccugagcaaggccgaccucgagaacccccaccuccccgagaagaagaucacccaguggcuggagacgaagggcguggagcgccugaagcggauggcgaucuccggcgacgacugcguggucaagcccaucgacgaccgcuucgccaacgcccugcuggcccucaacgacauggggaaggugcggaaggacaucccccaguggcagcccagcaagggcuggcacgacuggcagcaggucccguucugcucccaccacuuccacgagcugaucaugaaggacgggcgcaagcuggucgugcccugccggccccaggacgagcucaucggccgcgcccggaucagccagggggcgggcuggucccugaaggagaccgccugccugggcaaggccuacgcccagauguggagccucauguacuuccaccgccgcgaccugcggcuggcguccaacgccaucugcagcgccgugcccguccacugggugccgaccucccgcaccacguggagcauccacgcccaccaccaguggaugaccaccgaggacaugcucaccguguggaaccgggucuggaucgaggacaaccccuggauggaggacaagacgcccgugaccaccugggagaacgugcccuaccuggggaagcgcgaggaccaguggugcggcagccugaucgggcucaccucccgggccacgugggcgcagaacaucccgaccgccauccagcagguccgcagccugaucggcaacgaggaguuccuggacuacaugcccuccaugaagcgguuccgcaaggaggaggagagcgagggggccaucugguga

SEQ ID NO: 10004 - RNA, 9873 nt, Artificial Sequence
  derived and/or modified CDS sequence (opt1) from DENV-3__GQ199863__SS-prME
accagccucugccucaugaugauccugcccgcggcgcuggcguuccaccucaccagccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggucauccugcccgaguacggcacccuggggcucgagugcuccccgcgcacgggccuggacuucaacgagaugauccugcucaccaugaagaacaaggcguggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgccaugcacacggcgcucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgucccgugcaagauccccuucagcacggaggacgggcagggcaaggcccacaacggccgccugaucaccgcgaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggccaccgcgcggggcgcccgccggauggccauccugggcgacacggccugggacuucggguccgugggcgggguccucaacagccugggcaagauggugcaccagaucuucggguccgccuacaccgcgcuguucagcggcguguccugggucaugaagaucggcaucggggugcuccugaccuggaucggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggccgacucccccaagcgccucgcgacggccaucgccggcgccugggagaacggggugugcggcauccgcagcaccacccggauggagaaccugcuguggaagcagaucgccaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggcgaagaucgucaccgccgagacgcagaacagcuccuucaucaucgacggccccaacacccccgagugccccagcgugucccgggccuggaacgugugggaggucgaggacuacggguucggcguguucaccaccaacaucuggcucaagcugcgcgagguguacacccagcugugcgaccaccggcucaugagcgccgcggucaaggacgagcgcgccgugcacgccgacaugggcuacuggaucgagagccagaagaacggguccuggaagcuggagaaggccagccugaucgaggugaagacgugcaccuggccgaagucccacacccucuggagcaacggcguccuggaguccgacaugaucauccccaagagccuggccgggcccaucucccagcacaaccaccggccgggcuaccacacccagacggcggggcccuggcaccucggcaagcuggagcuggacuucaacuacugcgagggcaccaccguggugaucaccgagaacugcgggacgcgcggccccagccuccggaccaccaccgucuccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaaggucgacaacuucaccaugggcgugcugugccucgccauccuguucgaggaggugaugcgggggaaguucggcaagaagcacaugaucgccggggucuucuucaccuucgugcugcuccuguccggccagaucaccuggcgcgacauggcccacacgcugaucaugaucggcagcaacgcguccgaccggauggggaugggcgugaccuaccucgcccugaucgccaccuucaagauccagcccuuccuggcccucggguucuuccugcgcaagcugaccagccgggagaaccuccugcugggcgucggccucgccauggcgacgacccugcagcugcccgaggacaucgagcagauggccaacgggaucgcccucggccugauggcccugaagcucaucacccaguucgagaccuaccagcuguggacggcgcugaucagccugaccugcuccaacaccaucuucacccugacgguggccuggcgcaccgccacccugauccucgccggggucagccugcugccggugugccaguccagcuccaugcggaagaccgacuggcuccccauggccguggcggccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggccggcccccugguggccggcgggcugcucaucgccugcuacgucaucaccgggaccuccgccgaccugaccguggagaaggccgccgacaucacgugggaggaggaggcggagcagaccggggugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgccguccucaccuacaacgggaagcgccuggagcccaacugggcguccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgccaucgcgcuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggccaucaagcgccggcuccgcacccugauccuggcgcccacccggguggucgccgccgagauggaggaggcccucaaggggcugcccauccgcuaccagaccacggccaccaaguccgagcacaccggccgggagaucguggaccugaugugccacgcgaccuucacgaugcgccuccugagccccgugcgggucccgaacuacaaccugaucaucauggacgaggcccacuucaccgaccccgccuccaucgccgcccgcggguacaucagcacccgggugggcaugggcgaggcggccgccaucuucaugaccgccacgccgcccgggaccgcggacgccuucccgcaguccaacgcccccauccaggacgaggagcgcgacauccccgagcgcagcuggaacuccggcaacgaguggaucaccgacuucgccgggaagaccgugugguucguccccagcaucaaggccggcaacgacaucgcgaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgccgcguccgccgcccagcggcgcggccggguggggcgcaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcccacaaggucgcgagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaucuacuccgacccgcuggcccucaaggaguucaaggaguucgccgccggccgcaagagcaucgcgcuggaccuggugacggagaucgggcggguccccucccaccucgcccaccgcacccggaacgcccuggacaaccuggugaugcuccacaccagcgagcacggcgggcgcgccuaccggcacgccguggaggagcugcccgagaccauggagacgcugcuccugcugggccucaugauccugcugaccgggggcgcgaugcuguuccugaucagcggcaaggggaucggcaagaccuccaucgggcugaucugcgucaucgccagcuccggcaugcucuggauggccgagaucccgcugcaguggaucgccagcgccaucgugcuggaguucuucaugauggugcuccugauccccgagcccgagaagcagcgcacgccccaggacaaccagcuggcguacgucgugaucgggauccucacgcuggccgccaucaucgccgccaacgagaugggccugcucgagaccaccaagcgggaccugggcauguccaaggagccggggguggucagccccaccuccuaccuggacguggaccuccaccccgcgagcgccuggacgcuguacgccguggccaccaccgucaucacccccaugcugcgccacacgaucgagaacuccaccgcgaacgugagccucgccgccaucgccaaccaggccgugguccugaugggccuggacaagggguggccgaucuccaagauggaccucggcgugccccugcuggcgcucgggugcuacagccaggugaacccccugacccugaccgccgccguccuccugcugaucacgcacuacgccaucaucggccccggccuccaggccaaggcgacccgggaggcccagaagcgcaccgccgccgggaucaugaagaacccgaccguggacggcaucaugacgaucgaccuggaccccgugaucuacgacuccaaguucgagaagcagcuggggcaggucaugcuccuggugcugugcgccgugcagcuccugcugaugcggaccagcugggcgcucugcgaggcccugacccuggccaccggccccaucacgacccucugggagggcucccccgggaaguucuggaacaccaccaucgccgucagcauggcgaacaucuuccgcggcuccuaccuggccggggccggccuggccuucagcaucaugaaguccguggggacgggcaagcggggcaccgggagccagggcgagacccucggggagaaguggaagaagaagcugaaccagcugagccgcaaggacuucgaccucuacaagaaguccggcaucaccgagguggaccggaccgaggccaaggaggggcugaagcgcggcgagaucacgcaccacgcggucagccggggcuccgccaagcugcagugguucguggagcgcaacauggugaucccggaggggcgggucaucgaccucggcugcgggcgcggcggguggagcuacuacugcgccggccugaagaaggugaccgaggugcggggcuacaccaagggcgggcccgggcacgaggagcccguccccauguccaccuacggcuggaacaucgugaagcugaugagcgggaaggacguguucuaccucccgcccgagaagugcgacacgcugcugugcgacaucggcgaguccagccccucccccaccgucgaggagagccgcaccauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugucccgcaacagcacgcacgagauguacuggaucuccaacggcaccgggaacaucgucgccagcgugaacauggugucccggcuccugcugaaccgcuucaccaugacccaccggcgcccgacgaucgagaaggacgucgaccucggcgccggcacccggcacgugaacgcggagcccgagacccccaacauggacgugaucggggagcgcaucaagcggaucaaggaggagcacaacagcaccuggcacuacgacgacgagaacccguacaagacgugggccuaccacggcuccuacgaggucaaggccaccgggagcgccuccagcaugaucaacggcguggucaagcugcugaccaagcccugggacguggugcccauggucacccagauggccaugacggacaccacccccuucgggcagcagcgcguguucaaggagaagguggacacccggacgccgcgcagcaugcccggcacccggcgcgucaugggcaucaccgcggaguggcucuggcggacccuggggcgcaacaagaagccccggcugugcacgcgcgaggaguucaccaagaaggugcgcaccaacgccgccaugggcgccguguucaccgaggagaaccagugggacuccgcgaaggccgccgucgaggacgaggacuucuggaagcucguggaccgggagcgcgagcugcacaagcuggggaagugcggcagcugcguguacaacaugauggggaagcgggagaagaagcucggcgaguucggcaaggccaaggggucccgcgccaucugguacauguggcugggcgcgcgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgccgacgacacggccgggugggacacccgcaucaccgaggacgaccugcacaacgaggagaagaucacccagcagauggacccggagcaccggcagcucgcgaacgccaucuucaagcugacguaccagaacaagguggugaagguccagcgccccacccccaccggcaccgugauggacaucaucagccggaaggaccagcgcggcuccggccaggugggcaccuacgggcugaacacguucaccaacauggaggcccagcucauccggcagauggagggcgaggggguccugagcaaggccgaccuggagaacccccaccucccggagaagaagaucacccaguggcuggagaccaagggcguggagcgccugaagcggauggccaucuccggcgacgacugcguggucaagcccaucgacgaccgcuucgcgaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcccggaucagccagggggccggcuggucccucaaggagacggcgugccugggcaaggccuacgcccagauguggagccugauguacuuccaccgccgcgaccuccggcuggccuccaacgcgaucugcagcgccgugcccguccacugggugccgaccucccgcaccaccuggagcauccacgcccaccaccaguggaugacgaccgaggacaugcugaccguguggaaccgggucuggaucgaggacaaccccuggauggaggacaagacccccgugacgaccugggagaacgugcccuaccucgggaagcgcgaggaccaguggugcggcagccugaucgggcugaccucccgggccaccugggcccagaacaucccgacggcgauccagcagguccgcagccucaucggcaacgaggaguuccuggacuacaugcccuccaugaagcgguuccgcaaggaggaggagagcgagggggccaucugguga

SEQ ID NO: 10005 - RNA, 9873 nt, Artificial Sequence
  derived and/or modified CDS sequence (opt1) from DENV-3__GQ199864__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcugaacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaucggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacaucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccggcguccugugggacgugcccagcccgcccgagacccagaaggccgagcuggaggaggggguguaccgcaucaagcagcagggcaucuucgggaagacccaggucggcgugggggugcagaaggagggcgucuuccacaccauguggcacgugacgcggggcgcggugcucaccuacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucguccgggaggcgaucaagcgccggcuccgcacccugauccuggcccccacccgggugguggccgccgagauggaggaggcccucaaggggcugcccauccgcuaccagaccacggcgaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggguacaucagcacccgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggaguucgccgcgggccgcaagagcaucgcccuggaccuggugaccgagaucgggcgggugcccucccaccucgcccaccgcacccggaacgcccuggacaaccuggucaugcuccacaccagcgagcacggcgggcgcgccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagaccaccaagcgggaccugggcauguccaaggagccggggguggugagccccacguccuaccuggacgucgaccuccaccccgccagcgccuggacccuguacgccguggcgaccaccgugaucacgcccaugcugcgccacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugacggccgccgugcuccugcugaucacccacuacgccaucaucggccccggccuccaggcgaaggccacccgggaggcccagaagcgcaccgccgccgggaucaugaagaacccgacggucgacggcaucaugaccaucgaccuggaccccgugaucuacgacuccaaguucgagaagcagcugggccaggugaugcuccugguccugugcgcggugcagcuccugcugaugcggaccagcugggcccucugcgaggcccugacccuggccacgggccccaucaccacccucugggagggcucccccgggaaguucuggaacaccacgaucgcggugagcauggccaacaucuuccgcggcuccuaccuggccggggccggccuggccuucagcaucaugaaguccgucgggaccggcaagcggggcaccgggagccagggcgagacccucggggagaaguggaagaagaagcugaaccagcugagccgcaaggacuucgaccucuacaagaaguccggcaucaccgagguggaccggacggaggcgaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccgcaccauccgcguccugaagaugguggagccguggcucaagaacaaccaguucugcaucaaggugcugaaccccuacaugcccacggucaucgagcaccuggagcggcuccagcgcaagcacggcgggaugcuggugcggaacccccugucccgcaacagcacccacgagauguacuggaucuccaacggcaccgggaacaucguggccagcgucaacauggugucccggcuccugcugaaccgcuucaccaugacgcaccggcgcccgaccaucgagaaggacguggaccucggcgcgggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgucgugcccauggugacgcagauggcgaugaccgacaccacccccuucgggcagcagcgcgucuucaaggagaagguggacacgcggaccccgcgcagcaugcccggcacccggcgcgugaugggcaucaccgccgaguggcucuggcggacgcuggggcgcaacaagaagccccggcugugcacccgcgaggaguucaccaagaagguccgcaccaacgccgccaugggcgcgguguucacggaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcccagcucauccggcagauggagggcgagggggugcugagcaaggccgaccuggagaacccccaccucccggagaagaagaucacccaguggcuggagacgaagggcgucgagcgccugaagcggauggcgaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggcgggcuggucccucaaggagaccgccugccugggcaaggccuacgcccagauguggagccugauguacuuccaccgccgcgaccuccggcuggcguccaacgccaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10006 - RNA, 9873 nt, Artificial Sequence
  derived and/or modified CDS sequence (opt1) from DENV-3__GQ199865__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccgaugugccaguccagcuccaugcggaagaccgacuggcuccccauggcggucgccgccaugggcgugccgccccucccgcuguucaucuucagccucaaggacacgcugaagcgccgcuccuggccccugaacgagggggugauggccgucggccucgugagcauccuggccuccagccugcuccggaacgacgugcccauggcgggcccccuggucgccgggggccugcucaucgccugcuacgugaucaccgggaccuccgccgaccugaccguggagaaggccgcggacaucacguggggcgaggaggccgagcagaccggggucagccacaugcugaugaucaccguggaggacgacggcaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggggugcugugggacguccccagcccgcccgagacccagaaggccgagcuggaggagggcguguaccgcaucaagcagcaggggaucuucggcaagacccaggugggggucggcgugcagaaggagggcguguuccacaccauguggcacgucacgcgcggggcggugcucaccuacaacggcaagcgccuggagcccaacugggccuccgugaagaaggaccugaucagcuacgggggcggguggcggcucuccgcccaguggcagaagggcgaggagguccaggugaucgccguggagcccggcaagaaccccaagaacuuccagaccaugcccgggaccuuccagacgaccaccggcgagaucggggcgaucgcccuggacuucaagcccggcaccagcggcagccccaucaucaaccgcgaggggaaggucgugggccuguacgggaacggcguggucacgaagaacgggggcuacguguccggcaucgcccagaccaacgccgagccggacgggcccacccccgagcuggaggaggagauguucaagaagcggaaccucaccaucauggaccugcaccccggcagcgggaagacgcgcaaguaccugccggccaucgugcgggaggcgaucaagcgccggcuccgcacccugauccuggcccccacccgggucguggccgccgagauggaggaggcccucaagggccugcccauccgcuaccagaccacggcgaccaaguccgagcacaccgggcgggagaucguggaccugaugugccacgccaccuucacgaugcgccuccugagccccguccgggugccgaacuacaaccugaucaucauggacgaggcccacuucaccgaccccgccuccaucgccgcgcgcggcuacaucagcacccgggugggcaugggggaggccgccgccaucuucaugaccgcgacgccgcccggcaccgccgacgccuucccgcaguccaacgcccccauccaggacgaggagcgcgacauccccgagcgcagcuggaacuccgggaacgaguggaucaccgacuucgccggcaagaccgucugguucgugcccagcaucaaggcggggaacgacaucgccaacugccuccggaagaacggcaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacgggcccgagcgcgugauccuggccggccccaugccggugaccgcggccuccgccgcccagcggcgcgggcgggucggccgcaacccccagaaggagaacgaccaguacaucuucaccgggcagccccucaacaacgacgaggaccacgcccacuggaccgaggcgaagaugcugcuggacaacaucaacacgcccgagggcaucaucccggcccucuucgagcccgagcgggagaaguccgccgccaucgacggcgaguaccgccugaagggggagucccggaagaccuucguggagcugaugcgccggggcgaccuccccguguggcuggcgcacaaggucgccagcgaggggaucaaguacaccgaccgcaaguggugcuucgacggccagcggaacaaccagauccuggaggagaacauggacguggagaucuggaccaaggagggcgagaagaagaagcuccgcccccgguggcuggacgcccgcacguacuccgacccgcuggcccucaaggaguucaaggaguucgccgcggggcgcaagagcaucgcccuggaccuggucaccgagaucggccgggugcccucccaccucgcccaccgcacccggaacgcccuggacaaccuggugaugcuccacaccagcgagcacgggggccgcgccuaccggcacgcggucgaggagcugcccgagacgauggagacccugcuccugcuggggcucaugauccugcugaccggcggcgccaugcuguuccugaucagcgggaagggcaucgggaagaccuccaucggccugaucugcgugaucgccagcuccgggaugcucuggauggccgagaucccgcugcaguggaucgccagcgcgaucgugcuggaguucuucaugaugguccuccugauccccgagcccgagaagcagcgcacgccccaggacaaccagcuggccuacguggugaucggcauccucacccuggccgccaucaucgccgcgaacgagaugggccugcucgagaccaccaagcgggaccuggggauguccaaggagccgggcgucgugagccccacguccuaccuggacguggaccuccaccccgccagcgccuggacccuguacgccgucgcgaccaccgugaucacgcccaugcugcgccacaccaucgagaacuccaccgccaacgugagccucgccgccaucgccaaccaggcggucgugcugauggggcuggacaagggcuggccgaucuccaagauggaccucggggugccccugcuggcccucggcugcuacagccaggucaacccccugacccugacggccgccgugcuccugcugaucacccacuacgccaucaucggccccgggcuccaggcgaaggccacccgggaggcccagaagcgcaccgccgccggcaucaugaagaacccgacgguggacgggaucaugaccaucgaccuggaccccgucaucuacgacuccaaguucgagaagcagcugggccaggugaugcuccuggugcugugcgcgguccagcuccugcugaugcggaccagcugggcccucugcgaggcccugacccuggccacgggccccaucaccacccucugggaggggucccccggcaaguucuggaacaccacgaucgcggugagcauggccaacaucuuccgcggguccuaccuggccggcgccgggcuggccuucagcaucaugaaguccgugggcaccggcaagcgggggaccggcagccagggggagacccucggcgagaaguggaagaagaagcugaaccagcugagccgcaaggacuucgaccucuacaagaaguccgggaucaccgaggucgaccggacggaggcgaaggagggccugaagcgcggcgagaucacccaccacgccgugagccggggguccgccaagcugcagugguucguggagcgcaacauggucaucccggagggccgggugaucgaccucgggugcggccgcgggggcuggagcuacuacugcgccggccugaagaaggugaccgagguccggggguacaccaagggcgggcccggccacgaggagcccgugcccauguccacguacggguggaacaucgugaagcugaugagcggcaaggacgucuucuaccucccgcccgagaagugcgacacccugcugugcgacaucggcgaguccagccccucccccaccguggaggagagccgcaccauccgcgugcugaagauggucgagccguggcucaagaacaaccaguucugcaucaaggugcugaaccccuacaugcccacggugaucgagcaccuggagcggcuccagcgcaagcacgggggcaugcugguccggaacccccugucccgcaacagcacccacgagauguacuggaucuccaacgggaccggcaacaucguggccagcgugaacauggucucccggcuccugcugaaccgcuucaccaugacgcaccggcgcccgaccaucgagaaggacguggaccucggcgcggggacccggcacgugaacgccgagcccgagacccccaacauggacgucaucggcgagcgcaucaagcggaucaaggaggagcacaacagcacguggcacuacgacgacgagaacccguacaagaccugggccuaccacggguccuacgaggugaaggccaccggcagcgccuccagcaugaucaacgggguggucaagcugcugaccaagcccugggacgugguccccauggugacgcagauggcgaugaccgacaccacccccuucggccagcagcgcguguucaaggagaaggucgacacgcggaccccgcgcagcaugcccggcacccggcgcgugauggggaucaccgccgaguggcucuggcggacgcugggccgcaacaagaagccccggcugugcacccgcgaggaguucaccaagaaggugcgcaccaacgccgccaugggggcggucuucacggaggagaaccagugggacuccgccaaggccgccguggaggacgaggacuucuggaagcucguggaccgggagcgcgagcugcacaagcugggcaagugcgggagcugcgucuacaacaugaugggcaagcgggagaagaagcucggcgaguucgggaaggccaagggcucccgcgcgaucugguacauguggcugggggcccgguaccuggaguucgaggcccucggcuuccugaacgaggaccacugguucagccgcgagaacuccuacagcgggguggagggcgagggccugcacaagcucggguacauccugcgggacaucuccaagauccccggcggggccauguacgccgacgacaccgcgggcugggacacccgcaucaccgaggacgaccugcacaacgaggagaagaucacgcagcagauggacccggagcaccggcagcucgccaacgccaucuucaagcugaccuaccagaacaagguggucaaggugcagcgccccacccccaccggcaccgugauggacaucaucagccggaaggaccagcgcggguccggccaggucgggacguacggccugaacaccuucaccaacauggaggcccagcucauccggcagauggagggggagggcgugcugagcaaggccgaccuggagaacccccaccucccggagaagaagaucacccaguggcuggagacgaagggcguggagcgccugaagcggauggcgaucuccggggacgacugcgucgugaagcccaucgacgaccgcuucgccaacgcccuccuggcccugaacgacaugggcaaggugcggaaggacaucccccaguggcagcccagcaagggguggcacgacuggcagcaggucccguucugcucccaccacuuccacgagcucaucaugaaggacggccgcaagcugguggugcccugccggccccaggacgagcugaucgggcgcgcccggaucagccagggcgcgggcuggucccucaaggagaccgccugccuggggaaggccuacgcccagauguggagccugauguacuuccaccgccgcgaccuccggcuggcguccaacgccaucugcagcgccguccccgugcacugggugccgaccucccgcaccacguggagcauccacgcccaccaccaguggaugaccaccgaggacaugcugaccgucuggaaccggguguggaucgaggacaaccccuggauggaggacaagacgcccgugaccaccugggagaacguccccuaccucggcaagcgcgaggaccaguggugcgggagccugaucggccugaccucccgggccacgugggcgcagaacaucccgaccgccauccagcagguccgcagccucaucgggaacgaggaguuccuggacuacaugcccuccaugaagcgguuccgcaaggaggaggagagcgagggcgccaucugguga

SEQ ID NO: 10007 - RNA, 9873 nt, Artificial Sequence
  derived and/or modified CDS sequence (opt1) from DENV-3__GQ199870__SS-prME
accagccucugccucaugaugauccugcccgccgcccuggcguuccaccucaccagccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucgggcucaaggacacgcugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugaccgucgagaaggccgcggacaucacgugggaggaggaggccgagcagaccggggugucccacaaccugaugaucaccguggacgacgacggcaccaugcgcaucaaggacgacgagaccgagaacauccucacgguccugcugaagaccgcccuccugaucgugagcggcaucuucccguacuccauccccgccacccugcucguguggcacaccuggcagaagcagacgcagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacaccauguggcacgugacgcgcggggcggugcucaccuacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggaccuuccagacgaccaccggcgagaucggggcgaucgcccuggacuucaagcccggcaccuccggcagccccaucaucaaccgcgaggggaagguggugggccuguacgggaacggcgucgugacgaagaacgggggcuacgugagcggcaucgcccagaccaacgccgagccggacgggcccacccccgagcuggaggaggagauguucaagaagcggaaccucaccaucauggaccugcaccccggcuccgggaagacgcgcaaguaccugccggccaucguccgggaggcgaucaagcgccggcuccgcacccugauccuggcccccacccgggugguggccgccgagauggaggaggcccucaagggccugcccauccgcuaccagaccacggcgaccaagagcgagcacaccgggcgggagaucgucgaccugaugugccacgccaccuucacgaugcgccuccugucccccgugcgggugccgaacuacaaccugaucaucauggacgaggcccacuucaccgaccccgccagcaucgccgcgcgcggcuacaucuccacccgggucggcaugggggaggccgccgccaucuucaugaccgcgacgccgcccggcaccgccgacgccuucccgcagagcaacgcccccauccaggacgaggagcgcgacauccccgagcgcuccuggaacagcgggaacgaguggaucaccgacuucgccggcaagaccgugugguucgugcccuccaucaaggcggggaacgacaucgccaacugccuccggaagaacggcaagaaggucauccagcugagccgcaagacguucgacaccgaguaccagaagaccaagcugaacgacugggacuucguggugaccacggacaucuccgagaugggcgccaacuucaaggccgaccgggucaucgacccgcgccggugccucaagcccgugauccugaccgacgggcccgagcgcgugauccuggccggccccaugccggucaccgcggccagcgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacgcccgagggcaucaucccggcccucuucgagcccgagcgggagaaguccgccgccaucgacggcgaguaccgccugaagggggagagccggaagaccuucguggagcugaugcgccggggcgaccuccccgucuggcuggcgcacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcacguacagcgacccgcuggcccucaaggaguucaaggaguucgccgcggggcgcaaguccaucgcccuggaccuggugaccgagaucggccgggugcccagccaccucgcccaccgcacccggaacgcccuggacaaccuggucaugcuccacaccuccgagcacgggggccgcgccuaccggcacgcgguggaggagcugcccgagacgauggagacccugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgccuccgcgaucguccuggaguucuucaugauggugcuccugauccccgagcccgagaagcagcgcacgccccaggacaaccagcuggccuacguggucaucggcauccucacccuggccgccaucaucgccgcgaacgagaugggccugcucgagaccaccaagcgggaccuggggaugagcaaggagccgggcguggugucccccacgagcuaccuggacgucgaccuccaccccgccuccgccuggacccuguacgccguggcgaccaccgugaucacgcccaugcugcgccacaccaucgagaacagcaccgccaacgucucccucgccgccaucgccaaccaggcgguggugcugauggggcuggacaagggcuggccgaucagcaagauggaccucggggucccccugcuggcccucggcugcuacucccaggugaacccccugacccugacggccgccgugcuccugcugaucacccacuacgccaucaucggccccgggcuccaggcgaaggccacccgggaggcccagaagcgcaccgccgccggcaucaugaagaacccgacggucgacgggaucaugaccaucgaccuggaccccgugaucuacgacagcaaguucgagaagcagcugggccaggugaugcuccugguccugugcgcggugcagcuccugcugaugcggaccuccugggcccucugcgaggcccugacccuggccacgggccccaucaccacccucugggaggggagccccggcaaguucuggaacaccacgaucgcgguguccauggccaacaucuuccgcgggagcuaccuggccggcgccgggcuggccuucuccaucaugaaguccgucggcaccggcaagcgggggaccggcucccagggggagacccucggcgagaaguggaagaagaagcugaaccagcugagccgcaaggacuucgaccucuacaagaaguccgggaucaccgagguggaccggacggaggcgaaggagggccugaagcgcggcgagaucacccaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacaccaagggcgggcccggccacgaggagcccgugcccaugagcacguacggguggaacaucgucaagcugauguccggcaaggacguguucuaccucccgcccgagaagugcgacacccugcugugcgacaucggcgagagcucccccagccccaccguggaggagucccgcaccauccgcguccugaagaugguggagccguggcucaagaacaaccaguucugcaucaaggugcugaaccccuacaugcccacggucaucgagcaccuggagcggcuccagcgcaagcacgggggcaugcuggugcggaacccccugagccgcaacuccacccacgagaugagcuggaucuccaacgggaccggcaacaucguggccagcgucaacauggugucccggcuccugcugaaccgcagcaccaugacgcaccggcgcccgaccaucgagaaggacguggaccucggcgcggggccccggcacgucaacgccgaccccgagccgcccaacauggacgugaucggcgagcgcaucaagcgggugaaggaggagcacaacuccaccuggcacuacgacgacgagaaccccuacaagaccugggccuaccacgggagcuacgaggucaaggccacgggcuccgccagcagcaugaucaacgggguggucaagcugcugaccaagcccugggacguggugccgauggucccccagauggcgaugaccgacaccacgcccuucggccagcagcgcguguucaaggagaagguggacacccggacgccccgguccaucccgggcacccggcgcgucauggggaucacggccgaguggcucuggcggacccugggccgcaacaagaagccccggcugugcacccgcgaggaguucaccaagaaggugcgcacgaacgccgccaugggggcgguguucaccgaggagaaccagugggacagcgccaaggccgccgucgaggacgaggacuucuggaagcucguggaccgggagcgcgagcugcacaagcugggcaagugcggguccugcguguacaacaugaugggcaagcgggagaagaagcucggcgaguucgggaaggccaagggcagccgcgcgaucugguacauguggcugggggcccgguaccuggaguucgaggcccucggcuuccugaacgaggaccacugguucucccgcgagaacagcuacuccggggucgagggcgagggccugcacaagcucggguacauccugcgggacaucagcaagauccccggcggggccauguacgccgacgacaccgcgggcugggacacccgcaucacggaggacgaccugcacaacgaggagaagaucacccagcagauggaccccgagcaccggcagcucgccaacgccaucuucaagcugaccuaccagaacaagguggugaagguccagcgcccgacccccacgggcaccgugauggacaucaucucccggaaggaccagcgcgggagcggccagguggggaccuacggccugaacaccuucaccaacauggaggcccagcucauccggcagauggagggggagggcguccuguccaaggccgaccuggagaacccccaccuccccgagaagaagaucacgcaguggcuggagaccaagggcguggagcgccugaagcggauggcgaucagcggggacgacugcguggucaagccgaucgacgaccgcuucgccaacgcccuccuggcccugaacgacaugggcaaggugcggaaggacaucccccaguggcagcccuccaagggguggcacgacuggcagcagguccccuucugcagccaccacuuccacgagcucaucaugaaggacggccgcaagcuggucgugccgugccggccccaggacgagcugaucgggcgcgcccggaucucccagggcgcgggcuggagccucaaggagaccgccugccuggggaaggccuacgcccagauguggucccugauguacuuccaccgccgcgaccuccggcuggcgagcaacgccaucugcuccgccgugcccguccacugggugcccaccagccgcacgaccuggagcauccacgcccaccaccaguggaugaccaccgaggacaugcugacgguguggaaccgggucuggaucgaggacaacccguggauggaggacaagacccccgugaccaccugggagaacgugcccuaccucggcaagcgcgaggaccaguggugcgggucccugaucggccugacgagccgggccaccugggcgcagaacaucccgaccgccauccagcagguccgcucccucaucgggaacgaggaguuccuggacuacaugcccagcaugaagcgguuccgcaaggaggaggaguccgagggcgccaucugguga

SEQ ID NO: 10008 - RNA, 9873 nt, Artificial Sequence
  derived and/or modified CDS sequence (opt1) from DENV-3__JF937630__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacgcguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgucucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucagccucaaggacacccugaagcgccgcuccuggccccugaacgagggggucauggccgugggccucgugagcauccuggcguccagccugcuccggaacgacguccccauggccggcccccugguggccgggggccugcucaucgccugcuacgugaucacggggaccuccgccgaccugaccgucgagaaggcggccgacaucaccugggaggaggaggccgagcagacgggcgugagccacaaccugaugaucaccguggacgacgacgggaccaugcgcaucaaggacgacgagaccgagaacauccucaccguccugcugaagacggcccuccugaucguguccggcaucuucccguacagcauccccgccacccugcucguguggcacaccuggcagaagcagacccagcgguccggcguccugugggacgugcccagcccgcccgagacgcagaaggcggagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggcgaucguccgggaggccaucaagcgccggcuccgcacgcugauccuggcccccacccgggugguggccgccgagauggaggaggcgcucaaggggcugcccauccgcuaccagaccaccgccacgaaguccgagcacaccggccgggagaucgucgaccugaugugccacgccaccuucaccaugcgccuccugagccccgugcgggugccgaacuacaaccugaucaucauggacgaggcccacuucacggaccccgccuccaucgcggcccgcggguacaucagcacccgggucggcaugggcgaggccgccgcgaucuucaugaccgccacgccgcccgggacggccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagacguucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggaguucgcggccggccgcaagagcaucgcccuggaccuggugacggagaucgggcgggugcccucccaccucgcccaccgcacccggaacgcccuggacaaccuggucaugcuccacaccagcgagcacggcgggcgcgcguaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucguccuggaguucuucaugauggugcuccugauccccgagcccgagaagcagcgcacgccccaggacaaccagcuggccuacguggucaucgggauccucacgcuggccgccaucaucgcggccaacgagaugggccugcucgagaccaccaagcgggaccugggcauguccaaggagccggggguggugagccccaccuccuaccuggacgucgaccuccaccccgccagcgccuggacgcuguacgcgguggccaccaccgugaucacccccaugcugcgccacacgaucgagaacuccaccgccaacgucagccucgccgccaucgcgaaccaggccguggugcugaugggccuggacaagggguggccgaucuccaagauggaccucggcgucccccugcuggcccucgggugcuacagccaggugaacccccugacccugaccgccgccgugcuccugcugaucacgcacuacgcgaucaucggccccggccuccaggccaaggccacccgggaggcccagaagcgcaccgccgcggggaucaugaagaacccgaccgucgacggcaucaugacgaucgaccuggaccccgugaucuacgacuccaaguucgagaagcagcugggccaggugaugcuccugguccugugcgccgugcagcuccugcugaugcggaccagcugggcccucugcgaggcccugacccuggcgaccggccccaucacgacccucugggagggcucccccgggaaguucuggaacaccaccaucgccgugagcauggccaacaucuuccgcggcuccuaccuggccggggccggccuggcguucagcaucaugaaguccgucgggacgggcaagcggggcaccgggagccagggcgagacccucggggagaaguggaagaagaagcugaaccagcugagccgcaaggacuucgaccucuacaagaaguccggcaucaccgagguggaccggaccgaggccaaggaggggcugaagcgcggcgagaucacgcaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacgcacgagauguacuggaucuccaacggcaccgggaacaucguggcgagcgucaacauggugucccggcuccugcugaaccgcuucaccaugacccaccggcgcccgacgaucgagaaggacguggaccucggcgccggcacccggcacgucaacgccgagcccgagacccccaacauggacgugaucggggagcgcaucaagcggaucaaggaggagcacaacagcaccuggcacuacgacgacgagaacccguacaagacgugggccuaccacggcuccuacgaggugaaggccaccgggagcgcguccagcaugaucaacggcgucgugaagcugcugaccaagcccugggacgucgugcccauggugacccagauggccaugacggacaccacccccuucgggcagcagcgcgucuucaaggagaagguggacacccggacgccgcgcagcaugcccggcacccggcgcgugaugggcaucaccgccgaguggcucuggcggacccuggggcgcaacaagaagccccggcugugcacgcgcgaggaguucaccaagaagguccgcaccaacgccgcgaugggcgccguguucaccgaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgcggacgacacggccgggugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucagccggaaggaccagcgcggcuccggccaggugggcaccuacgggcugaacacguucaccaacauggaggcccagcucauccggcagauggagggcgagggggugcugagcaaggcggaccuggagaacccccaccucccggagaagaagaucacccaguggcuggagaccaagggcgucgagcgccugaagcggauggccaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcgcggaucagccagggggccggcuggucccucaaggagacggccugccugggcaaggccuacgcgcagauguggagccugauguacuuccaccgccgcgaccuccggcuggccuccaacgccaucugcagcgccgugcccgugcacugggucccgaccucccgcaccaccuggagcauccacgcccaccaccaguggaugacgaccgaggacaugcugaccguguggaaccggguguggaucgaggacaaccccuggauggaggacaagacccccgucacgaccugggagaacgugcccuaccucgggaagcgcgaggaccaguggugcggcagccugaucgggcugaccucccgggcgaccugggcccagaacaucccgacggccauccagcagguccgcagccucaucggcaacgaggaguuccuggacuacaugcccuccaugaagcgguuccgcaaggaggaggagagcgagggggccaucugguga

SEQ ID NO: 10009 - RNA, 9873 nt, Artificial Sequence
  derived and/or modified CDS sequence (opt1) from DENV-3__JN000936__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguggucuucaccuucgugcugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgucggccucgcgauggccacgacccugcagcugcccgaggacaucgagcagauggccaacgggaucgcccucggccugauggcgcugaagcucaucacccaguucgagaucuaccagcuguggaccgcccugaucagccucacgugcuccaacaccaucuucacccugaccguggccuggcgcacggccacccugauccucgccggggucagccugcugccgaugugccaguccagcuccaugcggaagaccgacuggcuccccauggcgguggccgccaugggcgugccgccccucccgcuguucaucuucagccucaaggacacccugaagcgccgcuccuggccccugaacgagggggucauggccgugggccucgugagcauccuggccuccagccugcuccggaacgacguccccauggcgggcccccugguggccgggggccugcucaucgccugcuacgugaucacggggaccuccgccgaccugaccgucgagaaggccgcggacaucaccugggaggaggaggccgagcagacgggcgugagccacaaccugaugaucaccguggacgacgacgggaccaugcgcaucaaggacgacgagaccgagaacauccucaccguccugcugaagacggcccuccugaucguguccggcaucuucccguacagcauccccgccacccugcucguguggcacaccuggcagaagcagacccagcgguccggcguccugugggacgugcccagcccgcccgagacgcagaaggccgagcuggaggaggggguguaccgcaucaagcagcagggcaucuucgggaagacccaggucggcgugggggugcagaaggagggcgucuuccacaccauguggcacgugacccggggcgcggugcucacguacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcaccuuccagaccacgaccggggagaucggcgcgaucgcccuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggccaucguccgggaggcgaucaagcgccggcuccgcacgcugauccuggcccccacccgggugguggccgccgagauggaggaggcccucaaggggcugcccauccgcuaccagaccaccgcgacgaaguccgagcacaccggccgggagaucgucgaccugaugugccacgccaccuucaccaugcgccuccugagccccgugcgggugccgaacuacaaccugaucaucauggacgaggcccacuucacggaccccgccuccaucgccgcgcgcggguacaucagcacccgggucggcaugggcgaggccgccgccaucuucaugaccgcgacgccgcccgggacggccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagucccggaagacguucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggaguucgccgcgggccgcaagagcaucgcccuggaccuggugacggagaucgggcgggugcccucccaccucgcccaccgcacccggaacgcccuggacaaccuggucaugcuccacaccagcgagcacggcgggcgcgccuaccggcacgcgguggaggagcugcccgagaccauggagacgcugcuccugcugggccucaugauccugcugaccgggggcgccaugcuguuccugaucagcggcaaggggaucggcaagaccuccaucgggcugaucugcgugaucaccagcuccggcaugcucuggauggccgagaucccgcugcaguggaucgccagcgccaucguccuggaguucuucaugauggugcuccugauccccgagcccgagaagcagcgcacgccccaggacaaccagcuggcguacguggucaucgggauccucacccuggccgccaucaucgccgccaacgagaugggccugcucgagaccaccaagcgggaccugggcauguccaaggagccggggguggugagccccacguccuaccuggacgucgaccuccaccccgcgagcgccuggacccuguacgccguggccaccaccgugaucacgcccaugcugcgccacaccaucgagaacuccaccgcgaacgucagccucgccgccaucgccaaccaggccguggugcugaugggccuggacaagggguggccgaucuccaagauggaccucggcgucccccugcuggcgcucgggugcuacagccaggugaacccccugacccugacggccgccgugcuccugcugaucacccacuacgccaucaucggccccggccuccaggccaaggcgacccgggaggcccagaagcgcaccgccgccgggaucaugaagaacccgacggucgacggcaucaugaccaucgaccuggaccccgugaucuacgacuccaaguucgagaagcagcugggccaggugaugcuccugguccugugcgccgugcagcuccugcugaugcggaccagcugggcgcucugcgaggcccugacccuggccacgggccccaucaccacccucugggagggcucccccgggaaguucuggaacaccacgaucgccgugagcauggcgaacaucuuccgcggcuccuaccuggccggggccggccuggccuucagcaucaugaaguccgucgggaccggcaagcggggcaccgggagccagggcgagacccucggggagaaguggaagaagaagcugaaccagcugagccgcaaggacuucgaccucuacaagaaguccggcaucaccgagguggaccggacggaggccaaggaggggcugaagcgcggcgagaucacccaccacgcggugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccgcaccauccgcguccugaagaugguggagccguggcucaagaacaaccaguucugcaucaaggugcugaaccccuacaugcccacggucaucgagcaccuggagcggcuccagcgcaagcacggcgggaugcuggugcggaacccccugucccgcaacagcacccacgagauguacuggaucuccaacggcaccgggaacaucguggccagcgucaacauggugucccggcuccugcugaaccgcuucaccaugacgcaccggcgcccgaccaucgagaaggacguggaccucggcgccggcacccggcacgucaacgcggagcccgagacccccaacauggacgugaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgucgugcccauggugacgcagauggccaugaccgacaccacccccuucgggcagcagcgcgucuucaaggagaagguggacacgcggaccccgcgcagcaugcccggcacccggcgcgugaugggcaucaccgcggaguggcucuggcggacgcuggggcgcaacaagaagccccggcugugcacccgcgaggaguucaccaagaagguccgcaccaacgccgccaugggcgccguguucacggaggagaaccagugggacuccgcgaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgccaucugguacauguggcugggcgcgcgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgccgggugggacacccgcaucaccgaggacgaccugcacaacgaggagaagaucacgcagcagauggacccggagcaccggcagcucgcgaacgccaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcccagcucauccggcagauggagggcgagggggugcugagcaaggccgaccuggagaacccccaccucccggagaagaagaucacccaguggcuggagacgaagggcgucgagcgccugaagcggauggccaucuccggcgacgacugcguggugaagcccaucgacgaccgcuucgcgaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggccggcuggucccucaaggagaccgcgugccugggcaaggccuacgcccagauguggagccugauguacuuccaccgccgcgaccuccggcuggccuccaacgcgaucugcagcgccgugcccgugcacugggucccgaccucccgcaccacguggagcauccacgcccaccaccaguggaugaccaccgacgacaugcugaccguguggaaccggguguggaucgaggacaaccccuggauggaggacaagacgcccgucaccaccugggagaacgugcccuaccucgggaagcgcgaggaccaguggugcggcagccugaucgggcugaccucccgggccacgugggcccagaacaucccgaccgcgauccagcagguccgcagccucaucggcaacgaggaguuccuggacuacaugcccuccaugaagcgguuccgcaaggaggaggagagcgagggggccaucugguga

SEQ ID NO: 10010 - RNA, 9873 nt, Artificial Sequence
  derived and/or modified CDS sequence (opt1) from DENV-3__HQ541796__SS-prME
accagccucugccucaugaugauccugcccgccgcccuggcguuccaccucaccagccgggacggcgagccgcggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagaccugggcccugcgccacccgggguucaccauccucgcgcuguuccuggcccacuacaucggcaccucccucacccagaagguggugaucuucauccugcugaugcucgucacccccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaccgucaucggcaucggggacaacgcccugaagaucaacugguacaagaagggcuccagcaucgggaagauguucgaggcgacggcccggggcgcccgccggauggccauccugggcgacaccgccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacacguccaugagcuucuccugcaucgccaucgggaucaucacccucuaccugggcgccguggugcaggccgacauggggugcgucaucaacuggaagggcaaggagcugaagugcggcagcgggaucuucgugaccaacgaggugcacaccuggacggagcaguacaaguuccaggcggacucccccaagcgccucgccaccgccaucgccggcgccugggagaacggggucugcggcauccgcagcaccacccggauggagaaccugcuguggaagcagaucgcgaacgagcucaacuacauccugugggagaacaacaucaagcugacggugguggucggggacaucaucggcgugcucgagcagggcaagcgcacccugacgccccagccgauggagcugaaguacuccuggaagaccugggggaaggccaagaucgugacggccgagacccagaacagcuccuucaucaucgacggccccaacacccccgagugccccagcgucucccgggccuggaacgugugggagguggaggacuacggguucggcgucuucaccaccaacaucuggcucaagcugcgcgagguguacacgcagcugugcgaccaccggcucaugagcgcggccgugaaggacgagcgcgccguccacgccgacaugggcuacuggaucgagagccagaagaacggguccuggaagcuggagaaggccagccugaucgaggugaagaccugcaccuggccgaagucccacacccucuggagcaacggcgugcuggaguccgacaugaucauccccaagagccuggcggggcccaucucccagcacaaccaccggccgggcuaccacacgcagaccgccgggcccuggcaccucggcaagcuggagcuggacuucaacuacugcgagggcaccaccgucgugaucacggagaacugcgggacccgcggccccagccuccggaccaccacgguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucacguggcgcgacauggcgcacacccugaucaugaucggcagcaacgccuccgaccggauggggaugggcgugaccuaccucgcccugaucgccaccuucaagauccagcccuuccuggcccucggguucuuccugcgcaagcugacgagccgggagaaccuccugcugggcgugggccucgcgauggccaccacccugcagcugcccgaggacaucgagcagauggccaacgggaucgcccucggccugauggcgcugaagcucaucacccaguucgagacguaccagcuguggaccgcccugaucagccugaccugcuccaacaccaucuucacgcugaccgucgccuggcgcaccgccacccugauccucgccggggugagccugcugccggucugccaguccagcuccaugcggaagacggacuggcuccccauggcgguggccgccaugggcgugccgccccucccgcuguucaucuucgggcucaaggacacccugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugacggucgagaaggccgcggacaucaccugggaggaggaggccgagcagaccggggugucccacaaccugaugaucaccguggacgacgacggcaccaugcgcaucaaggacgacgagacggagaacauccucaccguccugcugaagaccgcccuccugaucgugagcggcaucuucccguacuccauccccgccacccugcucguguggcacacguggcagaagcagacccagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacacgauguggcacgugacccgcggggcggugcucaccuacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggacguuccagaccaccaccggcgagaucggggcgaucgcccuggacuucaagcccggcacguccggcagccccaucaucaaccgcgaggggaagguggugggccuguacgggaacggcgucgugaccaagaacgggggcuacgugagcggcaucgcccagaccaacgccgagccggacgggcccacccccgagcuggaggaggagauguucaagaagcggaaccucacgaucauggaccugcaccccggcuccgggaagacccgcaaguaccugccggccaucguccgggaggcgaucaagcgccggcuccgcacccugauccuggcccccacccgggugguggccgccgagauggaggaggcccucaagggccugcccauccgcuaccagacgaccgcgaccaagagcgagcacaccgggcgggagaucgucgaccugaugugccacgccacguucaccaugcgccuccugucccccgugcgggugccgaacuacaaccugaucaucauggacgaggcccacuucaccgaccccgccagcaucgccgcgcgcggcuacaucuccacccgggucggcaugggggaggccgccgccaucuucaugacggcgacgccgcccggcaccgccgacgccuucccgcagagcaacgcccccauccaggacgaggagcgcgacauccccgagcgcuccuggaacagcgggaacgaguggaucaccgacuucgccggcaagacggugugguucgugcccuccaucaaggcggggaacgacaucgccaacugccuccggaagaacggcaagaaggucauccagcugagccgcaagaccuucgacaccgaguaccagaagaccaagcugaacgacugggacuucguggugacgaccgacaucuccgagaugggcgccaacuucaaggccgaccgggucaucgacccgcgccggugccucaagcccgugauccugaccgacgggcccgagcgcgugauccuggccggccccaugccggucaccgcggccagcgccgcccagcggcgcgggcgggugggccgcaacccccagaaggagaacgaccaguacaucuucaccgggcagccccucaacaacgacgaggaccacgcccacuggacggaggcgaagaugcugcuggacaacaucaacacccccgagggcaucaucccggcccucuucgagcccgagcgggagaaguccgccgccaucgacggcgaguaccgccugaagggggagagccggaagaccuucguggagcugaugcgccggggcgaccucaccgucuggcuggcgcacaagguggccuccgaggggaucaaguacacggaccgcaaguggugcuucgacggccagcggaacaaccagauccuggaggagaacauggacgucgagaucuggaccaaggagggcgagaagaagaagcuccgcccccgguggcuggacgcccgcaccuacagcgacccccuggcccucaaggaguucaaggaguucgccgcggggcgcaaguccaucgcccuggaccuggugaccgagaucggccgggugccgagccaccucgcccaccgcacgcggaacgcccuggacaaccuggucaugcuccacaccuccgagcacgggggccgcgccuaccggcacgcgguggaggagcugcccgagaccauggagacccugcuccugcuggggcucaugauccugcugacgggcggcgccaugcuguuccugaucagcgggaagggcaucgggaagaccagcaucggccugaucugcgugaucgccuccagcgggaugcucuggauggccgagaucccccugcaguggaucgccuccgcgaucguccuggaguucuucaugauggugcuccugaucccggagcccgagaagcagcgcacgccccaggacaaccagcuggccuacguggucaucggcauccucacccuggccgccaucaucgccgcgaacgagaugggccugcucgagacgaccaagcgggaccuggggaugagcaaggagcccggcgugguguccccgaccagcuaccuggacgucgaccuccaccccgccuccgccuggacccuguacgccguggcgacgaccgugaucacccccaugcugcgccacaccaucgagaacagcacggccaacgucucccucgccgccaucgccaaccaggcgguggugcugauggggcuggacaagggcuggcccaucagcaagauggaccucggggucccgcugcuggcccucggcugcuacucccaggugaacccccugacccugaccgccgccgugcuccugcugaucacccacuacgccaucaucggccccgggcuccaggcgaaggccacgcgggaggcccagaagcgcaccgccgccggcaucaugaagaaccccaccgucgacgggaucaugaccaucgaccuggacccggugaucuacgacagcaaguucgagaagcagcugggccaggugaugcuccugguccugugcgcggugcagcuccugcugaugcggacguccugggcccucugcgaggcccugacccuggccaccggccccaucaccacgcucugggaggggagccccggcaaguucuggaacaccaccaucgcgguguccauggccaacaucuuccgcgggagcuaccuggccggcgccgggcuggccuucuccaucaugaaguccgucggcaccggcaagcgggggaccggcucccagggggagacgcucggcgagaaguggaagaagaagcugaaccagcugagccgcaaggacuucgaccucuacaagaaguccgggaucaccgagguggaccggaccgaggcgaaggagggccugaagcgcggcgagaucacccaccacgccgugucccgggggagcgccaagcugcagugguucgucgagcgcaacauggugauccccgagggccgggugaucgaccucgggugcggccgcgggggcugguccuacuacugcgccggccugaagaaggucacggaggugcggggguacaccaagggcgggccgggccacgaggagcccgugcccaugagcaccuacggguggaacaucgucaagcugauguccggcaaggacguguucuaccucccgcccgagaagugcgacacccugcugugcgacaucggcgagagcucccccagccccacgguggaggagucccgcaccauccgcguccugaagaugguggagcccuggcucaagaacaaccaguucugcaucaaggugcugaaccccuacaugcccaccgucaucgagcaccuggagcggcuccagcgcaagcacgggggcaugcuggugcggaacccccugagccgcaacuccacccacgagauguacuggaucagcaacgggacgggcaacaucguggccuccgucaacauggugagccggcuccugcugaaccgcuucaccaugacccaccggcgccccaccaucgagaaggacguggaccucggcgcggggacgcggcacgucaacgccgagccggagacccccaacauggacgugaucggcgagcgcaucaagcggaucaaggaggagcacaacuccaccuggcacuacgacgacgagaaccccuacaagaccugggccuaccacgggagcuacgaggugaaggccacgggcuccgccagcuccaugaucaacggggucgugaagcugcugaccaagccgugggacgucgugcccauggugacccagauggcgaugaccgacacgacccccuucggccagcagcgcgucuucaaggagaagguggacacccggacgccccggagcaugccgggcacgcggcgcgugauggggaucaccgccgaguggcucuggcggacccugggccgcaacaagaagccccggcugugcacccgcgaggaguucacgaagaagguccgcaccaacgccgccaugggggcgguguucaccgaggagaaccagugggacagcgccaaggccgccguggaggacgaggacuucuggaagcucgucgaccgggagcgcgagcugcacaagcugggcaagugcggguccugcguguacaacaugaugggcaagcgggagaagaagcucggcgaguucgggaaggccaagggcagccgcgcgaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgccgacgacaccgcgggcugggacacgcgcaucaccgaggacgaccugcacaacgaggagaagaucacccagcagauggaccccgagcaccggcagcucgccaacgccaucuucaagcugaccuaccagaacaaggucgugaaggugcagcgcccgacccccacgggcaccgucauggacaucaucucccggaaggaccagcgcgggagcggccagguggggaccuacggccugaacaccuucacgaacauggaggcccagcucauccggcagauggagggggagggcgugcuguccaaggccgaccuggagaacccccaccuccccgagaagaagaucacccaguggcuggagaccaagggcgucgagcgccugaagcggauggcgaucagcggggacgacugcguggugaagccgaucgacgaccgcuucgccaacgcccuccuggcccugaacgacaugggcaagguccggaaggacaucccccaguggcagcccuccaagggguggcacgacuggcagcagguccccuucugcagccaccacuuccacgagcucaucaugaaggacggccgcaagcugguggucccgugccggccccaggacgagcugaucgggcgcgcccggaucucccagggcgcgggcuggagccucaaggagaccgccugccuggggaaggccuacgcccagauguggucccugauguacuuccaccgccgcgaccuccggcuggcgagcaacgccaucugcuccgccgugcccgugcacuggguccccacgagccgcaccaccugguccauccacgcccaccaccaguggaugaccacggaggacaugcugaccguguggaaccggguguggaucgaggacaacccguggauggaggacaagacccccgucaccacgugggagaacgugcccuaccucggcaagcgcgaggaccaguggugcgggagccugaucggccugaccagccgggccaccugggcgcagaacauccccaccgccauccagcagguccgcucccucaucgggaacgaggaguuccuggacuacaugccgagcaugaagcgguuccgcaaggaggaggaguccgagggcgccaucugguga

SEQ ID NO: 10011 - RNA, 9873 nt, Artificial Sequence
  derived and/or modified CDS sequence (opt1) from DENV-3__HQ166034__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaucuaccagcuguggaccgcccugaucagccucacgugcuccaacaccaucuucacccugaccgucgccuggcgcacggccacccugauccucgccggggugagccugcugccgaugugccaguccagcuccaugcggaagaccgacuggcuccccauggcggucgccgccaugggcgugccgccccucccgcuguucaucuucagccucaaggacacccugaagcgccgcuccuggccccugaacgagggggugauggccgucggccucgugagcauccuggccuccagccugcuccggaacgacgugcccauggcgggcccccuggucgccgggggccugcucaucgccugcuacgugaucacggggaccuccgccgaccugaccguggagaaggccgcggacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcaucuucccguacagcauccccgccacccugcucguguggcacaccuggcagaagcagacccagcgguccggcgugcugugggacguccccagcccgcccgagacgcagaaggccgagcuggaggaggggguguaccgcaucaagcagcagggcaucuucgggaagacccaggugggcgucggggugcagaaggagggcguguuccacaccauguggcacgucacccggggcgcggugcucacguacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagaccacgaccggggagaucggcgcgaucgcccuggacuucaagcccgggaccagcggcagccccaucaucaaccgcgagggcaaggucguggggcuguacggcaacgggguggucaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggccaucgugcgggaggcgaucaagcgccggcuccgcacgcugauccuggcccccacccgggucguggccgccgagauggaggaggcccucaaggggcugcccauccgcuaccagaccaccgcgacgaaguccgagcacaccggccgggagaucguggaccugaugugccacgccaccuucaccaugcgccuccugagccccguccgggugccgaacuacaaccugaucaucauggacgaggcccacuucacggaccccgccuccaucgccgcgcgcggguacaucagcacccgggugggcaugggcgaggccgccgccaucuucaugaccgcgacgccgcccgggacggccgacgccuucccgcaguccaacgcccccauccaggacgaggagcgcgacauccccgagcgcagcuggaacuccggcaacgaguggaucaccgacuucgccgggaagaccgucugguucgugcccagcaucaaggcgggcaacgacaucgccaacugccuccggaagaacgggaagaaggugauccagcugucccgcaagaccuucgacacggaguaccagaagaccaagcugaacgacugggacuucgucgugaccaccgacaucagcgagaugggcgccaacuucaaggccgaccgggugaucgacccgcgccggugccucaagcccgucauccugacggacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagucccggaagacguucguggagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcccucaaggaguucaaggaguucgccgcgggccgcaagagcaucgcccuggaccuggucacggagaucgggcgggugcccucccaccucgcccaccgcacccggaacgcccuggacaaccuggugaugcuccacaccagcgagcacggcgggcgcgccuaccggcacgcggucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcgcacgccccaggacaaccagcuggccuacguggugaucgggauccucacgcuggccgccaucaucgccgcgaacgagaugggccugcucgagaccaccaagcgggaccugggcauguccaaggagccgggggucgugagccccaccuccuaccuggacguggaccuccaccccgccagcgccuggacgcuguacgccgucgcgaccaccgugaucacccccaugcugcgccacacgaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugaccgccgccgugcuccugcugaucacgcacuacgccaucaucggccccggccuccaggcgaaggccacccgggaggcccagaagcgcaccgccgccgggaucaugaagaacccgaccguggacggcaucaugacgaucgaccuggaccccgucaucuacgacuccaaguucgagaagcagcugggccaggugaugcuccuggugcugugcgucgugcagcuccugcugaugcggaccagcugggcgcucugcgaggcccugacccuggccaccggccccaucacgacccucugggagggcucccccgggaaguucuggaacaccaccaucgccgugagcauggcgaacaucuuccgcggcuccuaccuggccggggccggccuggccuucagcaucaugaaguccgucgggacgggcaagcggggcaccgggagccagggcgagacccucggggagaaguggaagaagaagcugaaccagcugagccgcaaggacuucgaccucuacaagaaguccggcaucaccgagguggaccggaccgaggccaaggaggggcugaagcgcggcgagaucacgcaccacgcggugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacgcacgagauguacuggaucuccaacggcaccgggaacaucguggccagcgucaacauggugucccggcuccugcugaaccgcuucaccaugacccaccggcgcccgacgaucgagaaggacguggaccucggcgccggcacccggcacgucaacgcggagcccgagacccccaacauggacgugaucggggagcgcaucaagcggaucaaggaggagcacaacagcaccuggcacuacgacgacgagaacccguacaagacgugggccuaccacggcuccuacgaggugaaggccaccgggagcgccuccagcaugaucaacggcgucgugaagcugcugaccaagcccugggacgucgugcccauggugacccagauggccaugacggacaccacccccuucgggcagcagcgcgucuucaaggagaagguggacacccggacgccgcgcagcaugcccggcacccggcgcgugaugggcaucaccgcggaguggcucuggcggacccuggggcgcaacaagaagccccggcugugcacgcgcgaggaguucaccaagaagguccgcaccaacgccgccaugggcgccguguucaccgaggagaaccagugggacuccgcgaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgccaucugguacauguggcugggcgcgcgguaccuggaguucgaggcccucggguuccugaacgaggaccacugguucagccgcgagaacuccuacagcggcguggagggggagggccugcacaagcucggcuacauccugcgggacaucuccaagauccccggggccgccauguacgccgacgacacggcgggcugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccgggaccgucauggacaucaucagccggaaggaccagcgcggcuccggccagguggggaccuacggccugaacacguucaccaacauggaggcccagcucauccggcagauggagggggagggcgugcugagcaaggccgaccuggagaacccccaccucccggagaagaagaucacccaguggcuggagaccaagggggucgagcgccugaagcggauggcgaucuccggcgacgacugcguggugaagcccaucgacgaccgcuucgccaacgcccuccuggcccugaacgacaugggcaagguccggaaggacaucccccaguggcagcccagcaagggguggcacgacuggcagcaggucccguucugcucccaccacuuccacgagcucaucaugaaggacggccgcaagcuggugguccccugccggccccaggacgagcugaucgggcgcgcccggaucagccagggcgcgggguggucccucaaggagacggccugccugggcaaggccuacgcccagauguggagccugauguacuuccaccgccgcgaccuccggcuggcguccaacgccaucugcagcgccgugcccgugcacugggucccgaccucccgcaccaccuggagcauccacgcccaccaccaguggaugacgaccgaggacaugcugaccguguggaaccggguguggaucgaggacaaccccuggauggaggacaagacccccgucacgaccugggagaacgugcccuaccucggcaagcgcgaggaccaguggugcgggagccugaucggccugaccucccgggccaccugggcgcagaacaucccgacggccauccagcagguccgcagccucaucgggaacgaggaguuccuggacuacaugcccuccaugaagcgguuccgcaaggaggaggagagcgagggcgccaucugguga

SEQ ID NO: 10012 - RNA, 9873 nt, Artificial Sequence
  derived and/or modified CDS sequence (opt1) from DENV-3__HM756274__SS-prME
accagccugugccucaugaugauccugcccgccgcccuggcguuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacgcguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgucucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucgggcucaaggacacccugaagcgccgcagcuggccccugaacgagggcgucauggccgugggccucguguccauccuggcgagcucccugcuccggaacgacguccccauggccgggccccugguggccggcgggcugcucaucgccugcuacgugaucacgggcaccagcgccgaccugaccgucgagaaggcggccgacaucaccugggaggaggaggccgagcagacgggggugucccacaaccugaugaucaccguggacgacgacggcaccaugcgcaucaaggacgacgagaccgagaacauccucaccguccugcugaagacggcccuccugaucgugagcggcaucuucccguacuccauccccgccacccugcucguguggcacaccuggcagaagcagacccagcggagcgggguccugugggacgugcccagcccgcccgagacgcagaaggcggagcuggaggagggcguguaccgcaucaagcagcaggggaucuucggcaagacccaggucggggugggcgugcagaaggagggcgucuuccacaccauguggcacgugacccgcggggccgugcucacgcacaacggcaagcgccuggagcccaacugggccagcgucaagaaggaccugaucuccuacgggggcggguggcggcucagcgcccaguggcagaagggcgaggagguccaggugaucgcggucgagcccggcaagaaccccaagaacuuccagaccaugcccgggaccuuccagaccacgaccggcgagaucggggccaucgcccuggacuucaagcccggcaccuccggcagccccaucaucaaccgcgaggggaagguggugggccuguacgggaacggcgucgugaccaagaacgggggcuacgugagcggcaucgcccagacgaacgccgagccggacgggcccacccccgagcuggaggaggagauguucaagaagcggaaccucaccaucauggaccugcaccccggcuccgggaagacccgcaaguaccugccggcgaucguccgggaggccaucaagcgccggcuccgcacgcugauccuggcccccacccgggugguggccgccgagauggaggaggcgcucaagggccugcccauccgcuaccagaccaccgccaccaaguccgagcacaccgggcgggagaucgucgaccugaugugccacgccaccuucaccaugcgccuccugucccccgugcgggugccgaacuacaaccugaucaucauggacgaggcccacuucacggaccccgccagcaucgcggcccgcggcuacaucuccacccgggucggcaugggggaggccgccgcgaucuucaugaccgccacgccgcccggcacggccgacgccuucccgcagagcaacgcccccauccaggacgaggagcgcgacauccccgagcgcuccuggaacagcgggaacgaguggaucaccgacuucgcgggcaagaccgugugguucgugcccuccaucaaggccgggaacgacaucgccaacugccuccggaagaacggcaagaaggucauccagcugagccgcaagaccuucgacacggaguaccagaagaccaagcugaacgacugggacuucguggugaccaccgacaucuccgagaugggcgccaacuucaaggccgaccgggucaucgacccgcgccggugccucaagcccgugauccugacggacgggcccgagcgcgugauccuggcgggccccaugccggucaccgccgccagcgccgcccagcggcgcgggcgggugggccgcaacccccagaaggagaacgaccaguacaucuucaccgggcagccccucaacaacgacgaggaccacgcgcacuggaccgaggccaagaugcugcuggacaacaucaacacccccgagggcaucaucccggcccucuucgagcccgagcgggagaaguccgccgcgaucgacggcgaguaccgccugaagggggagagccggaagacguucguggagcugaugcgccggggcgaccuccccgucuggcuggcccacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcaccuacagcgacccgcuggcccucaaggaguucaaggaguucgcggccgggcgcaaguccaucgcccuggaccuggugacggagaucggccgggugcccagccaccucgcccaccgcacccggaacgcccuggacaaccuggucaugcuccacaccuccgagcacgggggccgcgcguaccggcacgccguggaggagcugcccgagaccauggagacgcugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgcguccgccaucguccuggaguucuucaugauggugcuccugauccccgagcccgagaagcagcgcacgccccaggacaaccagcuggccuacguggucaucggcauccucacgcuggccgccaucaucgcggccaacgagaugggccugcucgagaccaccaagcgggaccuggggaugagcaaggagccgggcguggugucccccaccagcuaccuggacgucgaccuccaccccgccuccgccuggacgcuguacgcgguggccaccaccgugaucacccccaugcugcgccacacgaucgagaacagcaccgccaacgucucccucgccgccaucgcgaaccaggccguggugcugauggggcuggacaagggcuggccgaucagcaagauggaccucggggucccccugcuggcccucggcugcuacucccaggugaacccccugacccugaccgccgccgugcuccugcugaucacgcacuacgcgaucaucggccccgggcuccaggccaaggccacccgggaggcccagaagcgcaccgccgcgggcaucaugaagaacccgaccgucgacgggaucaugacgaucgaccuggaccccgugaucuacgacagcaaguucgagaagcagcugggccaggugaugcuccugguccugugcgccgugcagcuccugcugaugcggaccuccugggcccucugcgaggcccugacccuggcgaccggccccaucacgacccucugggaggggagccccggcaaguucuggaacaccaccaucgccguguccauggccaacaucuuccgcgggagcuaccuggccggcgccgggcuggcguucuccaucaugaaguccgucggcacgggcaagcgggggaccggcucccagggggagacccucggcgagaaguggaagaagaagcugaaccagcugagccgcaaggacuucgaccucuacaagaaguccgggaucaccgagguggaccggaccgaggccaaggagggccugaagcgcggcgagaucacgcaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacaccaagggcgggcccggccacgaggagcccgugcccaugagcaccuacggguggaacaucgucaagcugauguccggcaaggacguguucuaccucccgcccgagaagugcgacacgcugcugugcgacaucggcgagagcucccccagccccaccguggaggagucccgcaccauccgcguccugaagaugguggagccguggcucaagaacaaccaguucugcaucaaggugcugaaccccuacaugcccaccgucaucgagcaccuggagcggcuccagcgcaagcacgggggcaugcuggugcggaacccccugagccgcaacuccacgcacgagauguacuggaucagcaacgggaccggcaacaucguggcguccgucaacauggugagccggcuccugcugaaccgcuucaccaugacccaccggcgcccgacgaucgagaaggacguggaccucggcgccgggacccggcacgucaacgccgagcccgagacccccaacauggacgugaucggcgagcgcaucaagcggaucaaggaggagcacaacuccaccuggcacuacgacgacgagaacccguacaagacgugggccuaccacgggagcuacgaggugaaggccaccggcuccgcgagcuccaugaucaacggggucgugaagcugcugaccaagcccugggacgucgugcccauggugacccagauggccaugacggacaccacccccuucggccagcagcgcgucuucaaggagaagguggacacccggacgccgcgcagcaugcccggcacccggcgcgugauggggaucaccgccgaguggcucuggcggacccugggccgcaacaagaagccccggcugugcacgcgcgaggaguucaccaagaagguccgcaccaacgccgcgaugggggccguguucaccgaggagaaccagugggacagcgccaaggccgccguggaggacgaggacuucuggaagcucgucgaccgggagcgcgagcugcacaagcugggcaagugcggguccugcguguacaacaugaugggcaagcgggagaagaagcucggcgaguucgggaaggcgaagggcagccgcgccaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgcggacgacacggccggcugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucucccggaaggaccagcgcgggagcggccagguggggaccuacggccugaacacguucaccaacauggaggcccagcucauccggcagauggagggggagggcgugcuguccaaggcggaccuggagaacccccaccucccggagaagaagaucacccaguggcuggagaccaagggcgucgagcgccugaagcggauggccaucagcggggacgacugcguggugaagcccaucgacgaccgcuucgccaacgcccuccuggcccugaacgacaugggcaagguccggaaggacaucccccaguggcagcccuccaagggguggcacgacuggcagcaggucccguucugcagccaccacuuccacgagcucaucaugaaggacggccgcaagcuggugguccccugccggccccaggacgagcugaucgggcgcgcgcggaucucccagggcgccggcuggagccucaaggagacggccugccuggggaaggccuacgcgcagauguggucccugauguacuuccaccgccgcgaccuccggcuggccagcaacgccaucugcuccgccgugcccgugcacugggucccgaccagccgcaccaccugguccauccacgcccaccaccaguggaugacgaccgaggacaugcugaccguguggaaccggguguggaucgaggacaaccccuggauggaggacaagacccccgucacgaccugggagaacgugcccuaccucggcaagcgcgaggaccaguggugcgggagccugaucggccugaccagccgggcgaccugggcccagaacaucccgacggccauccagcagguccgcucccucaucgggaacgaggaguuccuggacuacaugcccagcaugaagcgguuccgcaaggaggaggaguccgagggcgccaucugguga

SEQ ID NO: 10013 - RNA, 9873 nt, Artificial Sequence
  derived and/or modified CDS sequence (opt1) from DENV-3__HM756275__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaucuaccagcuguggaccgcccugaucagccucacgugcuccaacaccaucuucacccugaccgucgccuggcgcacggccacccugauccucgccggggugagccugcugccgaugugccaguccagcuccaugcggaagaccgacuggcuccccauggcggucgccgccaugggcgugccgccccucccgcuguucaucuucagccucaaggacacccugaagcgccgcuccuggccccugaacgagggggugauggccgucggccucgugagcauccuggccuccagccugcuccggaacgacgugcccauggcgggcccccuggucgccgggggccugcucaucgccugcuacgugaucacggggaccuccgccgaccugaccguggagaaggccgcggacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcaucuucccguacagcauccccgccacccugcucguguggcacaccuggcagaagcagacccagcgguccggcgugcugugggacguccccagcccgcccgagacgcagaaggccgagcuggaggaggggguguaccgcaucaagcagcagggcaucuucgggaagacccaggugggcgucggggugcagaaggagggcguguuccacaccauguggcacgucacccggggcgcggugcucacguacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagaccacgaccggggagaucggcgcgaucgcccuggacuucaagcccgggaccagcggcagccccaucaucaaccgcgagggcaaggucguggggcuguacggcaacgggguggucaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggccaucgugcgggaggcgaucaagcgccggcuccgcacgcugauccuggcccccacccgggucguggccgccgagauggaggaggcccucaaggggcugcccauccgcuaccagaccaccgcgacgaaguccgagcacaccggccgggagaucguggaccugaugugccacgccaccuucaccaugcgccuccugagccccguccgggugccgaacuacaaccugaucaucauggacgaggcccacuucacggaccccgccuccaucgccgcgcgcggguacaucagcacccgggugggcaugggcgaggccgccgccaucuucaugaccgcgacgccgcccgggacggccgacgccuucccgcaguccaacgcccccauccaggacgaggagcgcgacauccccgagcgcagcuggaacuccggcaacgaguggaucaccgacuucgccgggaagaccgucugguucgugcccagcaucaaggcgggcaacgacaucgccaacugccuccggaagaacgggaagaaggugauccagcugucccgcaagaccuucgacacggaguaccagaagaccaagcugaacgacugggacuucgucgugaccaccgacaucagcgagaugggcgccaacuucaaggccgaccgggugaucgacccgcgccggugccucaagcccgucauccugacggacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagucccggaagacguucguggagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcccucaaggaguucaaggaguucgccgcgggccgcaagagcaucgcccuggaccuggucacggagaucgggcgggugcccucccaccucgcccaccgcacccggaacgcccuggacaaccuggugaugcuccacaccagcgagcacggcgggcgcgccuaccggcacgcggucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcgcacgccccaggacaaccagcuggccuacguggugaucgggauccucacgcuggccgccaucaucgccgcgaacgagaugggccugcucgagaccaccaagcgggaccugggcauguccaaggagccgggggucgugagccccaccuccuaccuggacguggaccuccaccccgccagcgccuggacgcuguacgccgucgcgaccaccgugaucacccccaugcugcgccacacgaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugaccgccgccgugcuccugcugaucacgcacuacgccaucaucggccccggccuccaggcgaaggccacccgggaggcccagaagcgcaccgccgccgggaucaugaagaacccgaccguggacggcaucaugacgaucgaccuggaccccgucaucuacgacuccaaguucgagaagcagcugggccaggugaugcuccuggugcugugcgucgugcagcuccugcugaugcggaccagcugggcgcucugcgaggcccugacccuggccaccggccccaucacgacccucugggagggcucccccgggaaguucuggaacaccaccaucgccgugagcauggcgaacaucuuccgcggcuccuaccuggccggggccggccuggccuucagcaucaugaaguccgucgggacgggcaagcggggcaccgggagccagggcgagacccucggggagaaguggaagaagaagcugaaccagcugagccgcaaggacuucgaccucuacaagaaguccggcaucaccgagguggaccggaccgaggccaaggaggggcugaagcgcggcgagaucacgcaccacgcggugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacgcacgagauguacuggaucuccaacggcaccgggaacaucguggccagcgucaacauggugucccggcuccugcugaaccgcuucaccaugacccaccggcgcccgacgaucgagaaggacguggaccucggcgccggcacccggcacgucaacgcggagcccgagacccccaacauggacgugaucggggagcgcaucaagcggaucaaggaggagcacaacagcaccuggcacuacgacgacgagaacccguacaagacgugggccuaccacggcuccuacgaggugaaggccaccgggagcgccuccagcaugaucaacggcgucgugaagcugcugaccaagcccugggacgucgugcccauggugacccagauggccaugacggacaccacccccuucgggcagcagcgcgucuucaaggagaagguggacacccggacgccgcgcagcaugcccggcacccggcgcgugaugggcaucaccgcggaguggcucuggcggacccuggggcgcaacaagaagccccggcugugcacgcgcgaggaguucaccaagaagguccgcaccaacgccgccaugggcgccguguucaccgaggagaaccagugggacuccgcgaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgccaucugguacauguggcugggcgcgcgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacacggccgggugggacacccgcaucaccgaggacgaccugcacaacgaggagaagaucacccagcagauggacccggagcaccggcagcucgcgaacgccaucuucaagcugacguaccagaacaaggucgugaaggugcagcgccccacccccaccggcaccgucauggacaucaucagccggaaggaccagcgcggcuccggccaggugggcaccuacgggcugaacacguucaccaacauggaggcccagcucauccggcagauggagggcgagggggugcugagcaaggccgaccuggagaacccccaccucccggagaagaagaucacccaguggcuggagaccaagggcgucgagcgccugaagcggauggccaucuccggcgacgacugcguggugaagcccaucgacgaccgcuucgcgaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggccggcuggucccucaaggagacggcgugccugggcaaggccuacgcccagauguggagccugauguacuuccaccgccgcgaccuccggcuggccuccaacgcgaucugcagcgccgugcccgugcacugggucccgaccucccgcaccaccuggagcauccacgcccaccaccaguggaugacgaccgaggacaugcugaccguguggaaccggguguggaucgaggacaaccccuggauggaggacaagacccccgucacgaccugggagaacgugcccuaccucgggaagcgcgaggaccaguggugcggcagccugaucgggcugaccucccgggccaccugggcccagaacaucccgacggcgauccagcagguccgcagccucaucggcaacgaggaguuccuggacuacaugcccuccaugaagcgguuccgcaaggaggaggagagcgagggggccaucugguga

SEQ ID NO: 10014 - RNA, 9873 nt, Artificial Sequence
  derived and/or modified CDS sequence (opt1) from DENV-3__JF937632__SS-prME
accagccucugccucaugaugauccuccccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaucggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagcgcgccgcggacaucacgugggaggaggaggccgagcagaccggcgugagccacaaccugaugaucaccguggacgacgacgggaccaugcggaucaaggacgacgagaccgagaacauccucacgguccugcugaagaccgcccuccugaucguguccggcaucuucccguacagcauccccgccacccugcucguguggcacaccuggcagaagcagacgcagcgcuccggcguccugugggacgugcccagcccgcccgagacccagaaggccgagcuggaggaggggguguaccggaucaagcagcagggcaucuucgggaagacccaggucggcgugggggugcagaaggagggcgucuuccacaccauguggcacgugacgcgcggcgcggugcucaccuacaacgggaagcggcuggagcccaacugggccuccgucaagaaggaccugaucagcuacggcgggggcuggcgccucuccgcccaguggcagaagggggaggagguccaggugaucgccgucgagcccggcaagaaccccaagaacuuccagaccaugcccggcaccuuccagacgaccaccggggagaucggcgcgaucgcccuggacuucaagcccgggaccagcggcagccccaucaucaaccgggagggcaaggugguggggcuguacggcaacggggucgugacgaagaacggcggguacguguccggcaucgcccagaccaacgccgagccggacggccccacccccgagcuggaggaggagauguucaagaagcgcaaccucaccaucauggaccugcaccccgggagcggcaagacgcggaaguaccugccggccaucguccgcgaggcgaucaagcggcgccuccggacccugauccuggcccccacccgcgugguggccgccgagauggaggaggcccucaaggggcugcccauccgguaccagaccacggcgaccaaguccgagcacaccggccgcgagaucgucgaccugaugugccacgccaccuucacgaugcggcuccugagccccgugcgcgugccgaacuacaaccugaucaucauggacgaggcccacuucaccgaccccgccuccaucgccgcgcggggguacaucagcacccgcgucggcaugggcgaggccgccgccaucuucaugaccgcgacgccgcccgggaccgccgacgccuucccgcaguccaacgcccccauccaggacgaggagcgcgacauccccgagcggagcuggaacuccggcaacgaguggaucaccgacuucgccgggaagaccgugugguucgugcccagcaucaaggcgggcaacgacaucgccaacugccuccgcaagaacgggaagaaggucauccagcugucccggaagacguucgacaccgaguaccagaagaccaagcugaacgacugggacuucguggugaccacggacaucagcgagaugggcgccaacuucaaggccgaccgcgucaucgacccgcggcgcugccucaagcccgugauccugaccgacggccccgagcgggugauccuggccgggcccaugccggucaccgcggccuccgccgcccagcgccggggccgcguggggcggaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgcgagaaguccgccgccaucgacggcgaguaccggcugaagggcgagucccgcaagaccuucguggagcugaugcggcgcggggaccuccccgucuggcuggcgcacaagguggccagcgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccgcacguacuccgacccgcuggcccucaaggaguucaaggaguucgccgcgggccgcaagagcaucgcccuggaccuggugaccgagaucgggcgcgugcccucccaccucgcccaccggacccgcaacgcccuggacaaccuggucaugcuccacaccagcgagcacggcgggcgggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcggacgccccaggacaaccagcuggccuacguggucaucgggauccucacccuggccgccaucaucgccgcgaacgagaugggccugcucgagaccaccaagcgcgaccugggcauguccaaggagccggggguggugagccccacguccuaccuggacgucgaccuccaccccgccagcgccuggacccuguacgccguggcgaccaccgugaucacgcccaugcugcggcacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugacggccgccgugcuccugcugaucacccacuacgccaucaucggccccggccuccaggcgaaggccacccgcgaggcccagaagcggaccgccgccgggaucaugaagaacccgacggucgacggcaucaugaccaucgaccuggaccccgugaucuacgacuccaaguucgagaagcagcugggccaggugaugcuccugguccugugcgcggugcagcuccugcugaugcgcaccagcugggcccucugcgaggcccugacccuggccacgggccccaucaccacccucugggagggcucccccgggaaguucuggaacaccacgaucgcggugagcauggccaacaucuuccggggcuccuaccuggccggggccggccuggccuucagcaucaugaaguccgucgggaccggcaagcgcggcaccgggccgcagggcgagacccucggggagaaguggaagaagaagcugaaccagcugagccggaaggacuucgaccucuacaagaaguccggcaucaccgagguggaccgcacggaggcgaaggaggggcugaagcggggcgagaucacccaccacgccgugucccgcggcagcgccaagcugcagugguucgucgagcggaacauggugauccccgaggggcgcgugaucgaccucggcugcgggcggggcgggugguccuacuacugcgccggccugaagaaggucaccgaggugcgcggcuacaccaagggcgggcccgggcacgaggagcccgugccgaugagcacguacggcuggaacaucgucaagcugauguccgggaaggacguguucuaccugccgcccgagaagugcgacacccugcugugcgacaucggcgagagcucccccagcccgaccguggaggagucccgcaccauccggguccugaagaugguggagcccuggcucaagaacaaccaguucugcaucaaggugcugaaccccuacaugcccacggucaucgagcaccuggagcgccuccagcggaagcacggcgggaugcuggugcgcaacccgcugagccggaacuccacccacgagauguacuggaucagcaacggcaccgggaacaucguggccuccgucaacauggugagccgccuccugcugaaccgguucaccaugacgcaccgccggcccaccaucgagaaggacguggaccucggcgcgggcacccgccacgucaacgccgagcccgagaccccgaacauggacgugaucggggagcggaucaagcgcaucaaggaggagcacaacuccacguggcacuacgacgacgagaaccccuacaagaccugggccuaccacggcagcuacgaggugaaggccaccggguccgccagcuccaugaucaacggcgucgugaagcugcugaccaagcccugggacgucgugcccauggugacgcagauggcgaugaccgacaccaccccguucgggcagcagcgggucuucaaggagaagguggacacgcgcacgccccggagcaugcccggcacccgccgggugaugggcaucaccgccgaguggcucuggcgcacgcuggggcggaacaagaagccccgccugugcacccgcgaggaguucaccaagaagguccggaccaacgccgccaugggcgcgguguucacggaggagaaccagugggacagcgccaaggccgccguggaggacgaggacuucuggaagcucgucgaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcguggagggggagggccugcaccgccucggcuacauccugcgggacaucagcaagauccccggcggggccauguacgccgacgacaccgcggggugggacacccgcaucaccgaggacgaccugcacaacgaggagaagaucacgcagcagauggaccccgagcaccggcagcucgccaacgccaucuucaagcugaccuaccagaacaaggucgugaaggugcagcgccccacccccaccgggaccgucauggacaucaucucccggaaggaccagcgcggcagcggccaggugggcacguacgggcugaacaccuucaccaacauggaggcccagcucauccggcagauggagggcgagggggugcuguccaaggccgaccuggagaacccgcaccuccccgagaagaagaucacccaguggcuggagacgaagggcgucgagcgccugaagcggauggcgaucagcggcgacgacugcguggugaagcccaucgacgaccgcuucgccaacgcccuccuggcccugaacgacauggggaagguccggaaggacaucccccaguggcagccguccaagggcuggcacgacuggcagcagguccccuucugcagccaccacuuccacgagcucaucaugaaggacgggcgcaagcuggugguccccugccggccccaggacgagcugaucggccgcgcccgcaucucccagggggcgggcuggagccucaaggagaccgccugccugggcaaggccuacgcccagauguggucccugauguacuuccaccggcgcgaccuccggcuggcgagcaacgccaucugcuccgccgugccggugcacuggguccccaccagccgcaccacgugguccauccacgcccaccaccaguggaugaccaccgaggacaugcugaccguguggaaccggguguggaucgaggacaaccccuggauggaggacaagacgcccgucaccaccugggagaacgugccguaccucgggaagcgcgaggaccaguggugcggcagccugaucgggcugaccagccgggccacgugggcgcagaacauccccaccgccauccagcagguccgcucccucaucggcaacgaggaguuccuggacuacaugcccagcaugaagcgguuccgcaaggaggaggaguccgagggggccaucugguga

SEQ ID NO: 10015 - RNA, 9873 nt, Artificial Sequence
  derived and/or modified CDS sequence (opt1) from DENV-3__HM756281__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucgugaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgaaggagcugaaguacuccuggaagaccugggggaaggccaagaucgucaccgccgagacgcagaacagcuccuucaucaucgacggccccaacacccccgagugccccagcgugucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagacgugcaccuggccgaagucccacacccucuggagcaacggcguccuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccguggugaucaccgagaacugcgggacgcgcggccccagccuccggaccaccaccgucuccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaaggucgacaacuucaccaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgucggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacgguggccuggcgcaccgccacccugauccucgccggggucagccugcugccggugugccaguccagcuccaugcggaagaccgacuggcuccccauggcgguggccgccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacaucacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggaguucgccgcgggccgcaagagcaucgcccuggaccuggugaccgagaucgggcggguccccucccaccucgcccaccgcacccggaacgcccuggacaaccuggugaugcuccacaccagcgagcacggcgggcgcgccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcgcacgccccaggacaaccagcuggccuacgucgugaucgggauccucacccuggccgccaucaucgccgcgaacgagaugggccugcucgagaccaccaagcgggaccugggcauguccaaggagccggggguggucagccccacguccuaccuggacguggaccuccaccccgccagcgccuggacccuguacgccguggcgaccaccgucaucacgcccaugcugcgccacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgggaggcccagaagcgcaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcggaccagcugggcccucugcgaggcccugacccuggccacgggccccaucaccacccucugggagggcucccccgggaaguucuggaacaccacgaucgcggucagcauggccaacaucuuccgcggcuccuaccuggccggggccggccuggccuucagcaucaugaaguccguggggaccggcaagcggggcaccgggagccagggcgagacccucggggagaaguggaagaagaagcugaaccagcugagccgcaaggacuucgaccucuacaagaaguccggcaucaccgagguggaccggacggaggcgaaggaggggcugaagcgcggcgagaucacccaccacgccgucagccggggcuccgccaagcugcagugguucguggagcgcaacauggugaucccggaggggcgggucaucgaccucggcugcgggcgcggcggguggagcuacuacugcgccggccugaagaaggugaccgaggugcggggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccgcaccauccgcgugcugaagaugguggagccguggcucaagaacaaccaguucugcaucaagguccugaaccccuacaugcccacggugaucgagcaccuggagcggcuccagcgcaagcacggcgggaugcuggugcggaacccccugucccgcaacagcacccacgagauguacuggaucuccaacggcaccgggaacaucgucgccagcgugaacauggugucccggcuccugcugaaccgcuucaccaugacgcaccggcgcccgaccaucgagaaggacgucgaccucggcgcgggcacccggcacgugaacgccgagcccgagacccccaacauggacgugaucggggagcgcaucaagcggaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcgcguguuccgggagaagguggacacgcgcaccccgcggagcaugcccggcacccgccgggucaugggcaucaccgccgaguggcucuggcgcacgcuggggcggaacaagaagccccgccugugcacccgcgaggaguucaccaagaaggugcggaccaacgccgccaugggcgcgguguucacggaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucagccgcaaggaccagcggggcuccggccaggugggcacguacgggcugaacaccuucaccaacauggaggcccagcucauccgccagauggagggcgaggggguccugagcaaggccgaccuggagaacccccaccucccggagaagaagaucacccaguggcuggagacgaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccucaaggagaccgccugccugggcaaggccuacgcccagauguggagccugauguacuuccaccgccgggaccuccgccuggcguccaacgccaucugcagcgccgugcccguccacugggugccgaccucccggaccacguggagcauccacgcccaccaccaguggaugaccaccgaggacaugcugaccguguggaaccgcgucuggaucgaggacaaccccuggauggaggacaagacgcccgugaccaccugggagaacgugcccuaccucgggaagcgggaggaccaguggugcggcagccugaucgggcugaccucccgcgccacgugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 10016 - RNA, 9873 nt, Artificial Sequence
  derived and/or modified CDS sequence (opt1) from DENV-3__JF937643__SS-prME
accagccugugccucaugaugauccugcccgccgcccuggcguuccaccucaccagccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagaaggccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccgcccgggcuaccacacccagacggccgggcccuggcaccucggcaagcuggagcuggacuucaacuacugcgagggcaccaccgucgugaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccugguguccgccggcagcgggaagguggacaacuucaccaugggcguccugugccucgccauccuguucgaggaggugaugcgcgggaaguucggcaagaagcacaugaucgccgggguguucuucaccuucguccugcuccuguccggccagaucaccuggcgggacauggcgcacacgcugaucaugaucggcagcaacgccuccgaccgcauggggaugggcgugaccuaccucgcccugaucgccaccuucaagauccagcccuuccuggcccucggguucuuccugcggaagcugaccagccgcgagaaccuccugcugggcgugggccucgcgauggccacgacccugcagcugcccgaggacaucgagcagauggccaacgggaucgcccucggccugauggcgcugaagcucaucgcccaguucgagaccuaccagcuguggaccgcccugaucagccucacgugcuccaacaccaucuucacccugaccgucgccuggcggacggccacccugauccucgcgggggugagccugcugccggucugccaguccagcuccaugcgcaagaccgacuggcuccccauggccguggccgccaugggcgugccgccccucccgcuguucaucuucagccucaaggacacccugaagcggcgcuccuggccccugaacgagggggucauggccgugggccucgugagcauccuggcguccagccugcuccgcaacgacguccccauggccggcccccugguggccgggggccugcucaucgccugcuacgugaucacggggaccuccgccgaccugaccgucgagaaggcggccgacaucaccugggaggaggaggccgagcagacgggcgugagccacaaccugaugaucgccguggacgacgacgggaccaugcggaucaaggacgacgagaccgagaacauccucaccguccugcugaagaccgcccuccugaucguguccggcaucuucccguacagcauccccgcgacgcugcucguguggcacaccuggcagaagcagacccagcgcuccggcguccugugggacgugcccagcccgcccgagacccagaaggccgagcuggaggaggggguguaccggaucaagcagcagggcaucuucgggaagacgcaggucggcgugggggugcagaaggagggcgucuuccacaccauguggcacgugacccgcggcgccgugcucaccuacaacgggaagcggcuggagcccaacugggccuccgucaagaaggaccugaucagcuacggcgggggcuggcgccucuccgcgcaguggcagaagggggaggagguccaggugaucgccgucgagcccggcaagaaccccaagaacuuccagacgaugcccggcaccuuccagaccaccacgggggagaucggcgccaucgcccuggacuucaagcccgggaccagcggcagccccaucaucaaccgggagggcaaggugguggggcuguacggcaacggggucgugaccaagaacggcggguacguguccggcaucgcccagaccaacgcggagccggacggccccacgcccgagcuggaggaggagauguucaagaagcgcaaccucaccaucauggaccugcaccccgggagcggcaagacccggaaguaccugccggccaucguccgcgaggccaucaagcggcgccuccggacccugauccuggcccccacgcgcgugguggccgcggagauggaggaggcccucaaggggcugcccauccgguaccagaccaccgccaccaaguccgagcacacgggccgcgagaucgucgaccugaugugccacgccaccuucaccaugcggcuccugagccccgugcgcgugccgaacuacaaccugaucaucauggacgaggcccacuucaccgaccccgcguccaucgccgcccggggguacaucagcacgcgcgucggcaugggcgaggccgcggccaucuucaugaccgccacgccgcccgggaccgccgacgccuucccgcaguccaacgcgcccauccaggacgaggagcgggacauccccgagcgcagcuggaacuccggcaacgaguggaucacggacuucgccgggaagaccgugugguucgugcccagcaucaaggccggcaacgacaucgccaacugccuccgcaagaacgggaagaaggucauccagcugucccggaagaccuucgacaccgaguaccagaagacgaagcugaacgacugggacuucguggugaccaccgacaucagcgagaugggcgccaacuucaaggcggaccgcgucaucgacccgcggcgcugccucaagcccgugauccugaccgacggccccgagcgggugauccuggccgggcccaugccggucacggccgccuccgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagucccgcaagaccuucguggagcugaugcggcgcggggaccuccccgucuggcuggcccacaagguggccagcgagggcaucaaguacacggaccggaaguggugcuucgacgggcagcgcaacaaccagauccuggaggagaacauggacgucgagaucuggaccaaggagggcgagaagaagaagcuccggccccgcuggcuggacgcccggaccuacuccgacccgcuggcgcucaaggaguucaaggaguucgccgccggccgcaagagcaucgcccuggaccuggugaccgagaucgggcgcgugcccucccaccucgcccaccggacgcgcaacgcgcuggacaaccuggucaugcuccacaccagcgagcacggcgggcgggccuaccgccacgccguggaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugcucuggauggcggagaucccgcugcaguggaucgccagcgccaucguccuggaguucuucaugauggugcuccugauccccgagcccgagaagcagcggacgccccaggacaaccagcuggccuacguggucaucgggauccucacccuggccgcggugaucgccgccaacgagaugggccugcucgagacgaccaagcgcgaccugggcauguccaaggagccggggguggucagccccaccuccuaccuggacguggaccuccaccccgccagcgcguggacccuguacgccguggccacgaccgucaucacccccaugcugcggcacaccaucgagaacuccacggccaacgugagccucgccgcgaucgccaaccaggccgugguccugaugggccuggacaagggguggccgaucuccaagauggaccucggcgugccccugcuggcccucgggugcuacagccaggugaacccccugacccugaccgccgcgguccuccugcugaucacccacuacgccaucaucggccccggccuccaggccaaggccacgcgcgaggcccagaagcggaccgcggccgggaucaugaagaacccgaccguggacggcaucaugaccaucgaccuggaccccgugaucuacgacuccaaguucgagaagcagcuggggcaggucaugcuccuggugcugugcgccgugcagcuccugcugaugcgcacgagcugggcccucugcgaggcgcugacccuggccaccggccccaucaccacgcucugggagggcucccccgggaaguucuggaacaccaccaucgccgucagcauggccaacaucuuccggggcuccuaccuggccggggcgggccuggccuucagcaucaugaaguccguggggaccggcaagcgcggcacggggagccagggcgagacccucggggagaaguggaagaagaagcugaaccagcugagccggaaggacuucgaccucuacaagaaguccggcaucaccgagguggaccgcaccgaggccaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgcgggccugaagaaggugacggaggugcgcggcuacaccaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccacggucgaggagagccggaccauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacccacgagauguacuggaucuccaacggcacggggaacaucgucgccagcgugaacauggugucccgccuccugcugaaccgguucaccaugacccaccgccggccgaccaucgagaaggacgucgaccucggcgccggcacgcgccacgugaacgccgagcccgagacccccaacauggacgugaucggggagcggaucaagcgcaucaaggaggagcacaacagcaccuggcacuacgacgacgagaacccguacaagaccugggccuaccacggcuccuacgaggucaaggcgacggggagcgccuccagcaugaucaacggcguggucaagcugcugaccaagcccugggacguggugcccauggucacccagauggccaugaccgacacgacccccuucgggcagcagcggguguucaaggagaagguggacacccgcaccccgcggagcaugcccggcacgcgccgggucaugggcaucaccgccgaguggcucuggcgcacccuggggcggaacaagaagccccgccugugcacccgggaggaguucacgaagaaggugcgcaccaacgcggccaugggcgccguguucaccgaggagaaccagugggacuccgccaaggccgcggucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggccaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgcgauguacgccgacgacaccgccgggugggacacgcggaucaccgaggacgaccugcacaacgaggagaagaucacccagcagauggacccggagcaccgccagcucgccaacgccaucuucaagcugaccuaccagaacaagguggugaagguccagcggcccacgcccaccggcaccgugauggacaucaucagccgcaaggaccagcggggcuccggccaggugggcaccuacgggcugaacaccuucacgaacauggaggcgcagcucauccgccagauggagggcgaggggguccugagcaaggccgaccuggagaacccccaccucccggagaagaagaucacccaguggcuggagaccaagggcguggagcggcugaagcgcauggccaucuccggcgacgacugcguggucaagcccaucgacgaccgguucgccaacgcccuccuggcgcugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggccggcuggucccucaaggagaccgccugccugggcaaggcguacgcccagauguggagccugauguacuuccaccggcgcgaccuccgccuggccuccaacgccaucugcagcgccgugcccguccacugggugccgacgucccggaccaccuggagcauccacgcgcaccaccaguggaugaccacggacgacaugcugaccguguggaaccgcgucuggaucgaggacaaccccuggauggaggacaagacccccgugaccacgugggagaacgugcccuaccucgggaagcgggaggaccaguggugcggcagccugaucgggcugaccucccgcgccaccugggcccagaacaucccgaccgccauccagcagguccggagccucaucggcaacgaggaguuccuggacuacaugcccuccaugaagcgcuuccggaaggaggaggagagcgagggggccaucugguga

SEQ ID NO: 10017 - RNA, 9873 nt, Artificial Sequence
  derived and/or modified CDS sequence (opt1) from DENV-3__HM181972__SS-prME
accagccucugccucaugaugauccugcccgcggcgcuggcguuccaccucaccagccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggugcucggguucuuccugcgcaagcugaccagccgggagaaccuccugcugggcgucggccucgccauggcgacgacccugcagcugcccgaggacaucgagcagauggccaacgggaucgcccucggccugauggcccugaagcucaucacccaguucgagaccuaccagcuguggacggcgcugaucagccugaccugcuccaacaccaucuucacccugacgguggccuggcgcaccgccacccugauccucgccggggucagccugcugccggugugccaguccagcuccaugcggaagaccgacuggcuccccauggccguggcggccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggccggcccccugguggccggcgggcugcucaucgccugcuacgucaucaccgggaccuccgccgaccugaccguggagaaggccgccgacaucacgugggaggaggaggcggagcagaccggggugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgccguccucaccuacaacgggaagcgccuggagcccaacugggcguccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgccaucgcgcuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggccaucaagcgccggcuccgcacccugauccuggcgcccacccggguggucgccgccgagauggaggaggcccucaaggggcugcccauccgcuaccagaccacggccaccaaguccgagcacaccggccgggagaucguggaccugaugugccacgcgaccuucacgaugcgccuccugagccccgugcgggucccgaacuacaaccugaucaucauggacgaggcccacuucaccgaccccgccuccaucgccgcccgcggguacaucagcacccgggugggcaugggcgaggcggccgccaucuucaugaccgccacgccgcccgggaccgcggacgccuucccgcaguccaacgcccccauccaggacgaggagcgcgacauccccgagcgcagcuggaacuccggcaacgaguggaucaccgacuucgccgggaagaccgugugguucguccccagcaucaaggccggcaacgacaucgcgaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgccgcguccgccgcccagcggcgcggccggguggggcgcaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcccacaaggucgcgagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggaguucgccgccggccgcaagagcaucgcgcuggaccuggugaccgagaucgggcggguccccucccaccucgcccaccgcacccggaacgcccuggacaaccuggugaugcuccacaccagcgagcacggcgggcgcgccuaccggcacgccguggaggagcugcccgagacgauggagacccugcuccugcugggccucaugauccugcugaccgggggcgcgaugcuguuccugaucagcggcaaggggaucggcaagaccuccaucgggcugaucugcgucaucgccagcuccggcaugcucuggauggccgagaucccgcugcaguggaucgccagcgccaucgugcuggaguucuucaugauggugcuccugauccccgagcccgagaagcagcgcacgccccaggacaaccagcuggcguacgucgugaucgggauccucacccuggccgccaucaucgccgccaacgagaugggccugcucgagaccaccaagcgggaccugggcauguccaaggagccggggguggucagccccacguccuaccuggacguggaccuccaccccgcgagcgccuggacccuguacgccguggccaccaccgucaucacgcccaugcugcgccacaccaucgagaacuccaccgcgaacgugagccucgccgccaucgccaaccaggccgugguccugaugggccuggacaagggguggccgaucuccaagauggaccucggcgugccccugcuggcgcucgggugcuacagccaggugaacccccugacccugacggccgccguccuccugcugaucacccacuacgccaucaucggccccggccuccaggccaaggcgacccgggaggcccagaagcgcaccgccgccgggaucaugaagaacccgacgguggacggcaucaugaccaucgaccuggaccccgugaucuacgacuccaaguucgagaagcagcuggggcaggucaugcuccuggugcugugcgccgugcagcuccugcugaugcggaccagcugggcgcucugcgaggcccugacccuggccacgggccccaucaccacccucugggagggcucccccgggaaguucuggaacaccacgaucgccgucagcauggcgaacaucuuccgcggcuccuaccuggccggggccggccuggccuucagcaucaugaaguccguggggaccggcaagcggggcaccgggagccagggcgagacccucggggagaaguggaagaagaagcugaaccagcugagccgcaaggacuucgaccucuacaagaaguccggcaucaccgagguggaccggacggaggccaaggaggggcugaagcgcggcgagaucacccaccacgcggucagccggggcuccgccaagcugcagugguucguggagcgcaacauggugaucccggaggggcgggucaucgaccucggcugcgggcgcggcggguggagcuacuacugcgccggccugaagaaggugaccgaggugcggggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccgcaccauccgcgugcugaagaugguggagccguggcucaagaacaaccaguucugcaucaagguccugaaccccuacaugcccacggugaucgagcaccuggagcggcuccagcgcaagcacggcgggaugcuggugcggaacccccugucccgcaacagcacccacgagauguacuggaucuccaacggcaccgggaacaucgucgccagcgugaacauggugucccggcuccugcugaaccgcuucaccaugacgcaccggcgcccgaccaucgagaaggacgucgaccucggcgccggcacccggcacgugaacgcggagcccgagacccccaacauggacgugaucggggagcgcaucaagcggaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggccaugaccgacaccacccccuucgggcagcagcgcguguucaaggagaagguggacacgcggaccccgcgcagcaugcccggcacccggcgcgucaugggcaucaccgcggaguggcucuggcggacgcuggggcgcaacaagaagccccggcugugcacccgcgaggaguucaccaagaaggugcgcaccaacgccgccaugggcgccguguucacggaggagaaccagugggacuccgcgaaggccgccgucgaggacgaggacuucuggaagcucguggaccgggagcgcgagcugcacaagcuggggaagugcggcagcugcguguacaacaugauggggaagcgggagaagaagcucggcgaguucggcaaggccaaggggucccgcgccaucugguacauguggcugggcgcgcgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgccgacgacaccgccgggugggacacccgcaucaccgaggacgaccugcacaacgaggagaagaucacgcagcagauggacccggagcaccggcagcucgcgaacgccaucuucaagcugaccuaccagaacaagguggugaagguccagcgccccacccccaccggcaccgugauggacaucaucagccggaaggaccagcgcggcuccggccaggugggcacguacgggcugaacaccuucaccaacauggaggcccagcucauccggcagauggagggcgaggggguccugagcaaggccgaccuggagaacccccaccucccggagaagaagaucacccaguggcuggagacgaagggcguggagcgccugaagcggauggccaucuccggcgacgacugcguggucaagcccaucgacgaccgcuucgcgaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcccggaucagccagggggccggcuggucccucaaggagaccgcgugccugggcaaggccuacgcccagauguggagccugauguacuuccaccgccgcgaccuccggcuggccuccaacgcgaucugcagcgccgugcccguccacugggugccgaccucccgcaccacguggagcauccacgcccaccaccaguggaugaccaccgaggacaugcugaccguguggaaccgggucuggaucgaggacaaccccuggauggaggacaagacgcccgugaccaccugggggaacgugcccuaccucggcaagcgcgaggaccaguggugcgggagccugaucggccugaccucccgggccacgugggcccagaacaucccgaccgcgauccagcagguccgcagccucaucgggaacgaggaguuccuggacuacaugcccuccaugaagcgguuccgcaaggaggaggagagcgagggcgccaucugguga

SEQ ID NO: 10018 - RNA, 9873 nt, Artificial Sequence
  derived and/or modified CDS sequence (opt1) from DENV-3__HM631857__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacacggcgcacacccugaucaugaucggcagcaacgccuccgaccggauggggaugggcgugaccuaccucgcccugaucgccaccuucaagauccagcccuuccuggcccucggguucuuccugcgcaagcugacgagccgggagaaccuccugcugggcgugggccucgcgauggccaccacccugcagcugcccgaggacaucgagcagauggccaacgggaucgcccucggccugauggcgcugaagcucaucacccaguucgagacguaccagcuguggaccgcccugaucagccugaccugcuccaacaccaucuucacgcugaccgucgccuggcgcaccgccacccugauccucgccggggugagccugcugccggucugccaguccagcuccaugcggaagacggacuggcuccccauggcgguggccgccaugggcgugccgccccucccgcuguucaucuucgggcucaaggacacccugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugacggucgagaaggccgcggacaucaccugggaggaggaggccgagcagaccggggugucccacaaccugaugaucaccguggacgacgacggcaccaugcgcaucaaggacgacgagacggagaacauccucaccguccugcugaagaccgcccuccugaucgugagcggcaucuucccguacuccauccccgccacccugcucguguggcacacguggcagaagcagacccagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacacgauguggcacgugacccgcggggcggugcucaccuacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggacguuccagaccaccaccggcgagaucggggcgaucgcccuggacuucaagcccggcacguccggcagccccaucaucaaccgcgaggggaagguggugggccuguacgggaacggcgucgugaccaagaacgggggcuacgugagcggcaucgcccagaccaacgccgagccggacgggcccacccccgagcuggaggaggagauguucaagaagcggaaccucacgaucauggaccugcaccccggcuccgggaagacccgcaaguaccugccggccaucguccgggaggcgaucaagcgccggcuccgcacccugauccuggcccccacccgggugguggccgccgagauggaggaggcccucaagggccugcccauccgcuaccagacgaccgcgaccaagagcgagcacaccgggcgggagaucgccgaccugaugugccacgccacguucaccaugcgccuccugucccccguccgggugccgaacuacaaccugaucaucauggacgaggcccacuucaccgaccccgccagcaucgcggcccgcggcuacaucuccacccgggugggcaugggggaggccgccgcgaucuucaugacggccacgccgcccggcaccgccgacgccuucccgcagagcaacgcccccauccaggacgaggagcgcgacauccccgagcgcuccuggaacagcgggaacgaguggaucaccgacuucgcgggcaagacggucugguucgugcccuccaucaaggccgggaacgacaucgccaacugccuccggaagaacggcaagaaggugauccagcugagccgcaagaccuucgacaccgaguaccagaagaccaagcugaacgacugggacuucgucgugacgaccgacaucuccgagaugggcgccaacuucaaggccgaccgggugaucgacccgcgccggugccucaagcccgucauccugaccgacgggcccgagcgcgugauccuggcgggccccaugccggugaccgccgccagcgccgcccagcggcgcgggcgggucggccgcaacccccagaaggagaacgaccaguacaucuucaccgggcagccccucaacaacgacgaggaccacgcgcacuggacggaggccaagaugcugcuggacaacaucaacacccccgagggcaucaucccggcccucuucgagcccgagcgggagaaguccgccgcgaucgacggcgaguaccgccugaagggggagagccggaagaccuucguggagcugaugcgccggggcgaccuccccguguggcuggcccacaaggucgccuccgaggggaucaaguacaccgaccgcaaguggugcuucgacggccagcggaacaaccagauccuggaggagaacauggacguggagaucuggacgaaggagggcgagaagaagaagcuccgcccccgguggcuggacgcccgcaccuacagcgacccgcuggcccucaaggaguucaaggaguucgcggccgggcgcaaguccaucgcccuggaccuggucaccgagaucggccgggugcccagccaccucgcccaccgcacccggaacgcccuggacaaccuggugaugcuccacacguccgagcacgggggccgcgcguaccggcacgccgucgaggagcugcccgagaccauggagacccugcuccugcuggggcucaugauccugcugaccggcggcgccaugcuguuccugaucagcgggaagggcaucgggaagacgagcaucggccugaucugcgugaucgccuccagcgggaugcucuggauggccgagaucccgcugcaguggaucgcguccgccaucgugcuggaguucuucaugaugguccuccugauccccgagcccgagaagcagcgcacgccccaggacaaccagcuggccuacguggugaucggcauccucacccuggccgccgucaucgcggccaacgagaugggccugcucgagaccacgaagcgggaccuggggaugagcaaggagccgggcguggugucccccaccagcuaccuggacgucgaccuccaccccgccuccgccuggacccuguacgcgguggccaccacggugaucacccccaugcugcgccacaccaucgagaacagcaccgccaacgucucccucgccgccaucgcgaaccaggccguggugcugauggggcuggacaagggcuggccgaucagcaagauggaccucggggucccccugcuggcccucggcugcuacucccaggugaacccccugacgcugaccgccgccgugcuccugcugaucacccacuacgcgaucaucggccccgggcuccaggccaaggccacccgggaggcccagaagcgcacggccgcgggcaucaugaagaacccgaccgucgacgggaucaugaccaucgaccuggaccccgugaucuacgacagcaaguucgagaagcagcugggccaggugaugcuccugguccugugcgccgugcagcuccugcugaugcggaccuccugggcccucugcgaggcccugacgcuggcgaccggccccaucaccacccucugggaggggagccccggcaaguucuggaacacgaccaucgccguguccauggccaacaucuuccgcgggagcuaccuggccggcgccgggcuggcguucuccaucaugaaguccgucggcaccggcaagcgggggaccggcucccagggggagacccucggcgagaaguggaagaagaagcugaaccagcugagccgcaaggacuucgaccucuacaagaaguccgggaucacggagguggaccggaccgaggccaaggagggccugaagcgcggcgagaucacccaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacacgaagggcgggcccggccacgaggagcccgugcccaugagcaccuacggguggaacaucgucaagcugauguccggcaaggacguguucuaccucccgcccgagaagugcgacacccugcugugcgacaucggcgagagcucccccagccccaccguggaggagucccgcacgauccgcguccugaagaugguggagccguggcucaagaacaaccaguucugcaucaaggugcugaaccccuacaugcccaccgucaucgagcaccuggagcggcuccagcgcaagcacgggggcaugcuggugcggaacccccugagccgcaacuccacccacgagauguacuggaucagcaacgggaccggcaacaucguggcguccgucaacauggugagccggcuccugcugaaccgcuucacgaugacccaccggcgcccgaccaucgagaaggacguggaccucggcgccgggacccggcacgucaacguggagcccgagacgcccaacauggacgugaucggcgagcgcaucaagcggaucaaggaggagcacaacuccaccuggcacuacgacgacgagaacccguacaagaccugggccuaccacgggagcuacgaggucaaggccaccggcuccgccagcuccaugaucaacgggguggucaagcugcugacgaagcccugggacguggugcccauggucacccagauggcgaugaccgacaccacgcccuucggccagcagcgcguguucaaggagaagguggacacccggaccccgcgcagcaugcccggcacccggcgcgucauggggaucacggccgaguggcucuggcggacccugggccgcaacaagaagccccggcugugcacccgcgaggaguucaccaagaaggugcgcacgaacgccgccaugggggcgguguucaccgaggagaaccagugggacagcgccaaggccgccgucgaggacgaggacuucuggaagcucguggaccgggagcgcgagcugcacaagcugggcaagugcggguccugcguguacaacaugaugggcaagcgggagaagaagcucggcgaguucgggaaggccaagggcagccgcgcgaucugguacauguggcugggggcccgguaccuggaguucgaggcccucggcuuccugaacgaggaccacugguucucccgcgagaacagcuacuccggggucgagggcgagggccugcacaagcucggguacauccugcgggacaucagcaagauccccggcggggccauguacgccgacgacaccgcgggcugggacacccgcaucacggaggacgaccugcacaacgaggagaagaucacccagcagauggacccggagcaccggcagcucgccaacgccaucuucaagcugaccuaccagaacaagguggugaagguccagcgccccacccccaccggcacggugauggacaucaucucccggaaggaccagcgcgggagcggccagguggggaccuacggccugaacaccuucaccaacauggaggcccagcucauccggcagauggagggggagggcguccuguccaaggccgaccuggagaacccccaccucccggagaagaagaucacgcaguggcuggagaccaagggcguggagcgccugaagcggauggcgaucagcggggacgacugcguggucaagcccaucgacgaccgcuucgccaacgcccuccuggcccugaacgacaugggcaaggugcggaaggacaucccccaguggcagcccuccaagggguggcacgacuggcagcaggucccguucugcagccaccacuuccacgagcucaucaugaaggacggccgcaagcuggucgugcccugccggccccaggacgagcugaucgggcgcgcccggaucucccagggcgcgggcuggagccucaaggagaccgccugccuggggaaggccuacgcccagauguggucccugauguacuuccaccgccgcgaccuccggcuggcgagcaacgccaucugcuccgccgugcccguccacugggugccgaccagccgcacgaccugguccauccacgcccaccaccaguggaugaccaccgaggacaugcugacgguguggaaccgggucuggaucgaggacaaccccuggauggaggacaagacccccgugaccaccugggagaacgugcccuaccucggcaagcgcgaggaccaguggugcgggagccugaucggccugacgagccgggccaccugggcgcagaacaucccgaccgccauccagcagguccgcucccucaucgggaacgaggaguuccuggacuacaugcccagcaugaagcgguuccgcaaggaggaggaguccgagggcgccaucugguga

SEQ ID NO: 10019 - RNA, 9873 nt, Artificial Sequence
  derived and/or modified CDS sequence (opt1) from DENV-3__HM631860__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucgugaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgaaggagcugaaguacuccuggaagaccugggggaaggccaagaucgucaccgccgagacgcagaacagcuccuucaucaucgacggccccaacacccccgagugccccagcgugucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagacgugcaccuggccgaagucccacacccucuggagcaacggcguccuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccguggugaucaccgagaacugcgggacgcgcggccccagccuccggaccaccaccgucuccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaaggucgacaacuucaccaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgucggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccuacuucacccugacgguggccuggcgcaccgccacccugauccucgccggggucagccugcugccggugugccaguccagcuccaugcggaagaccgacuggcuccccauggcgguggccgccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacaucacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggaguucgccgcgggccgcaagagcaucgcccuggaccuggugaccgagaucgggcggguccccucccaccucgcccaccgcacccggaacgcccuggacaaccuggugaugcuccacaccagcgagcacggcgggcgcgccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcgcacgccccaggacaaccagcuggccuacgucgugaucgggauccucacccuggccgccaucaucgccgcgaacgagaugggccugcucgagaccaccaagcgggaccugggcauguccaaggagccggggguggucagccccacguccuaccuggacguggaccuccaccccgccagcgccuggacccuguacgccguggcgaccaccgucaucacgcccaugcugcgccacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgggaggcccagaagcgcaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcggaccagcugggcccucugcgaggcccugacccuggccacgggccccaucaccacccucugggagggcucccccgggaaguucuggaacaccacgaucgcggucagcauggccaacaucuuccgcggcuccuaccuggccggggccggccuggccuucagcaucaugaaguccguggggaccggcaagcggggcaccgggagccagggcgagacccucggggagaaguggaagaagaagcugaaccagcugagccgcaaggacuucgaccucuacaagaaguccggcaucaccgagguggaccggacggaggcgaaggaggggcugaagcgcggcgagaucacccaccacgccgucagccggggcuccgccaagcugcagugguucguggagcgcaacauggugaucccggaggggcgggucaucgaccucggcugcgggcgcggcggguggagcuacuacugcgccggccugaagaaggugaccgaggugcggggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccgcaccauccgcgugcugaagaugguggagccguggcucaagaacaaccaguucugcaucaagguccugaaccccuacaugcccacggugaucgagcaccuggagcggcuccagcgcaagcacggcgggaugcuggugcggaacccccugucccgcaacagcacccacgagauguacuggaucuccaacggcaccgggaacaucgucgccagcgugaacauggugucccggcuccugcugaaccgcuucaccaugacgcaccggcgcccgaccaucgagaaggacgucgaccucggcgcgggcacccggcacgugaacgccgagcccgagacccccaacauggacgugaucggggagcgcaucaagcggaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcgcguguucaaggagaagguggacacgcggaccccgcgcagcaugcccggcacccggcgcgucaugggcaucaccgccgaguggcucuggcggacgcuggggcgcaacaagaagccccggcugugcacccgcgaggaguucaccaagaaggugcgcaccaacgccgccaugggcgcgguguucacggaggagaaccagugggacuccgccaaggccgccgucgaggacgaggacuucuggaagcucguggaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaagguggugaagguccagcgccccacccccaccggcaccgugauggacaucaucagccggaaggaccagcgcggcuccggccaggugggcacguacgggcugaacaccuucaccaacauggaggcccagcucauccggcagauggagggcgaggggguccugagcaaggccgaccuggagaacccccaccucccggagaagaagaucacccaguggcuggagacgaagggcguggagcgccugaagcggauggcgaucuccggcgacgacugcguggucaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcccggaucagccagggggcgggcuggucccucaaggagaccgccugccugggcaaggccuacgcccagauguggagccugauguacuuccaccgccgcgaccuccggcuggcguccaacgccaucugcagcgccgugcccguccacugggugccgaccucccgcaccacguggagcauccacgcccaccaccaguggaugaccaccgaggacaugcugaccguguggaaccgggucuggaucgaggacaaccccuggauggaggacaagacgcccgugaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10020 - RNA, 9873 nt, Artificial Sequence
  derived and/or modified CDS sequence (opt1) from DENV-3__HM181977__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucgugaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgaaggagcugaaguacuccuggaagaccugggggaaggccaagaucgucaccgccgagacgcagaacagcuccuucaucaucgacggccccaacacccccgagugccccagcgugucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagacgugcaccuggccgaagucccacacccucuggagcaacggcguccuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccguggugaucaccgagaacugcgggacgcgcggccccagccuccggaccaccaccgucuccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaaggucgacaacuucaccaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgucggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacgguggccuggcgcaccgccacccugauccucgccggggucagccugcugccggugugccaguccagcuccaugcggaagaccgacuggcuccccauggcgguggccgccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacaucacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggaguucgccgcgggccgcaagagcaucgcccuggaccuggugaccgagaucgggcggguccccucccaccucgcccaccgcacccggaacgcccuggacaaccuggugaugcuccacaccagcgagcacggcgggcgcgccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcgcacgccccaggacaaccagcuggccuacgucgugaucgggauccucacccuggccgccaucaucgccgcgaacgagaugggccugcucgagaccaccaagcgggaccugggcauguccaaggagccggggguggucagccccacguccuaccuggacguggaccuccaccccgccagcgccuggacccuguacgccguggcgaccaccgucaucacgcccaugcugcgccacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgggaggcccagaagcgcaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcggaccagcugggcccucugcgaggcccugacccuggccacgggccccaucaccacccucugggagggcucccccgggaaguucuggaacaccacgaucgcggucagcauggccaacaucuuccgcggcuccuaccuggccggggccggccuggccuucagcaucaugaaguccguggggaccggcaagcggggcaccgggagccagggcgagacccucggggagaaguggaagaagaagcugaaccagcugagccgcaaggacuucgaccucuacaagaaguccggcaucaccgagguggaccggacggaggcgaaggaggggcugaagcgcggcgagaucacccaccacgccgucagccggggcuccgccaagcugcagugguucguggagcgcaacauggugaucccggaggggcgggucaucgaccucggcugcgggcgcggcggguggagcuacuacugcgccggccugaagaaggugaccgaggugcggggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccgcaccauccgcgugcugaagaugguggagccguggcucaagaacaaccaguucugcaucaagguccugaaccccuacaugcccacggugaucgagcaccuggagcggcuccagcgcaagcacggcgggaugcuggugcggaacccccugucccgcaacagcacccacgagauguacuggaucuccaacggcaccgggaacaucgucgccagcgugaacauggugucccggcuccugcugaaccgcuucaccaugacgcaccggcgcccgaccaucgagaaggacgucgaccucggcgcgggcacccggcacgugaacgccgagcccgagacccccaacauggacgugaucggggagcgcaucaagcggaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcgcguguucaaggagaagguggacacgcggaccccgcgcagcaugcccggcacccggcgcgucaugggcaucaccgccgaguggcucuggcggacgcuggggcgcaacaagaagccccggcugugcacccgcgaggaguucaccaagaaggugcgcaccaacgccgccaugggcgcgguguucacggaggagaaccagugggacuccgccaaggccgccgucgaggacgaggacuucuggaagcucguggaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaagguggugaagguccagcgccccacccccaccggcaccgugauggacaucaucagccggaaggaccagcgcggcuccggccaggugggcacguacgggcugaacaccuucaccaacauggaggcccagcucauccggcagauggagggcgaggggguccugagcaaggccgaccuggagaacccccaccucccggagaagaagaucacccaguggcuggagacgaagggcguggagcgccugaagcggauggcgaucuccggcgacgacugcguggucaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcccggaucagccagggggcgggcuggucccucaaggagaccgccugccugggcaaggccuacgcccagauguggagccugauguacuuccaccgccgcgaccuccggcuggcguccaacgccaucugcagcgccgugcccguccacugggugccgaccucccgcaccacguggagcauccacgcccaccaccaguggaugaccaccgaggacaugcugaccguguggaaccgggucuggaucgaggacaaccccuggauggaggacaagacgcccgugaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10021 - RNA, 9873 nt, Artificial Sequence
  derived and/or modified CDS sequence (opt1) from DENV-3__HM181978__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcuccgccagcgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucucccugaccugcagcaacaccaucuucacccugacggucgccuggcgcaccgccacccugauccucgccggggugucccugcugccggucugccagagcuccagcaugcggaagaccgacuggcuccccauggcgguggccgccaugggcgugccgccccucccgcuguucaucuucgggcucaaggacacgcugaagcgccgcuccuggccccugaacgagggcgucauggccgugggccucgugagcauccuggccuccagccugcuccggaacgacguccccauggcggggccccugguggccggcgggcugcucaucgccugcuacgugaucaccggcaccuccgccgaccugaccgucgagaaggccgcggacaucacgugggaggaggaggccgagcagaccggggugagccacaaccugaugaucaccguggacgacgacggcaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccgggguccugugggacgugcccagcccgcccgagacccagaaggccgagcuggaggagggcguguaccgcaucaagcagcaggggaucuucggcaagacccaggucggggugggcgugcagaaggagggcgucuuccacaccauguggcacgugacgcgcggggcggugcucaccuacaacggcaagcgccuggagcccaacugggccuccgucaagaaggaccugaucagcuacgggggcggguggcggcucuccgcccaguggcagaagggcgaggagguccaggugaucgccgucgagcccggcaagaaccccaagaacuuccagaccaugcccgggaccuuccagacgaccaccggcgagaucggggcgaucgcccuggacuucaagcccggcaccagcggcagccccaucaucaaccgcgaggggaagguggugggccuguacgggaacggcgucgugacgaagaacgggggcuacguguccggcaucgcccagaccaacgccgagccggacgggcccacccccgagcuggaggaggagauguucaagaagcggaaccucaccaucauggaccugcaccccggcagcgggaagacgcgcaaguaccugccggccaucguccgggaggcgaucaagcgccggcuccgcacccugauccuggcccccacccgggugguggccgccgagauggaggaggcccucaagggccugcccauccgcuaccagaccacggcgaccaaguccgagcacaccgggcgggagaucgucgaccugaugugccacgccaccuucacgaugcgccuccugagccccgugcgggugccgaacuacaaccugaucaucauggacgaggcccacuucaccgaccccgccuccaucgccgcgcgcggcuacaucagcacccgggucggcaugggggaggccgccgccaucuucaugaccgcgacgccgcccggcaccgccgacgccuucccgcaguccaacgcccccauccaggacgaggagcgcgacauccccgagcgcagcuggaacuccgggaacgaguggaucaccgacuucgccggcaagaccgugugguucgugcccagcaucaaggcggggaacgacaucgccaacugccuccggaagaacggcaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacgggcccgagcgcgugauccuggccggccccaugccggucaccgcggccuccgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacgcccgagggcaucaucccggcccucuucgagcccgagcgggagaaguccgccgccaucgacggcgaguaccgccugaagggggagucccggaagaccuucguggagcugaugcgccggggcgaccuccccgucuggcuggcgcacaagguggccagcgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcacguacuccgacccgcuggcccucaaggaguucaaggaguucgccgcggggcgcaagagcaucgcccuggaccuggugaccgagaucggccgggugcccucccaccucgcccaccgcacccggaacgcccuggacaaccuggucaugcuccacaccagcgagcacgggggccgcgccuaccggcacgcgguggaggagcugcccgagacgauggagacccugcuccugcuggggcucaugauccugcugaccggcggcgccaugcuguuccugaucagcgggaagggcaucgggaagaccuccaucggccugaucugcgugaucgccagcuccgggaugcucuggauggccgagaucccgcugcaguggaucgccagcgcgaucguccuggaguucuucaugauggugcuccugauccccgagcccgagaagcagcgcacgccccaggacaaccagcuggccuacguggucaucggcauccucacccuggccgccaucaucgccgcgaacgagaugggccugcucgagaccaccaagcgggaccuggggauguccaaggagccgggcguggugagccccacguccuaccuggacgucgaccuccaccccgccagcgccuggacccuguacgccguggcgaccaccgugaucacgcccaugcugcgccacaccaucgagaacuccaccgccaacgucagccucgccgccaucgccaaccaggcgguggugcugauggggcuggacaagggcuggccgaucuccaagauggaccucggggucccccugcuggcccucggcugcuacagccaggugaacccccugacccugacggccgccgugcuccugcugaucacccacuacgccaucaucggccccgggcuccaggcgaaggccacccgggaggcccagaagcgcaccgccgccggcaucaugaagaacccgacggucgacgggaucaugaccaucgaccuggaccccgugaucuacgacuccaaguucgagaagcagcugggccaggugaugcuccugguccugugcgcggugcagcuccugcugaugcggaccagcugggcccucugcgaggcccugacccuggccacgggccccaucaccacccucugggaggggucccccggcaaguucuggaacaccacgaucgcggugagcauggccaacaucuuccgcggguccuaccuggccggcgccgggcuggccuucagcaucaugaaguccgucggcaccggcaagcgggggaccggcagccagggggagacccucggcgagaaguggaagaagaagcugaaccagcugagccgcaaggacuucgaccucuacaagaaguccgggaucaccgagguggaccggacggaggcgaaggagggccugaagcgcggcgagaucacccaccacgccgugagccggggguccgccaagcugcagugguucgucgagcgcaacauggugaucccggagggccgggugaucgaccucgggugcggccgcgggggcuggagcuacuacugcgccggccugaagaaggucaccgaggugcggggguacaccaagggcgggcccggccacgaggagcccgugcccauguccacguacggguggaacaucgucaagcugaugagcggcaaggacguguucuaccucccgcccgagaagugcgacacccugcugugcgacaucggcgaguccagccccucccccaccguggaggagagccgcaccauccgcguccugaagaugguggagccguggcucaagaacaaccaguucugcaucaaggugcugaaccccuacaugcccacggucaucgagcaccuggagcggcuccagcgcaagcacgggggcaugcuggugcggaacccccugucccgcaacagcacccacgagauguacuggaucuccaacgggaccggcaacaucguggccagcgucaacauggugucccggcuccugcugaaccgcuucaccaugacgcaccggcgcccgaccaucgagaaggacguggaccucggcgcggggacccggcacgucaacgccgagcccgagacccccaacauggacgugaucggcgagcgcaucaagcggaucaaggaggagcacaacagcacguggcacuacgacgacgagaacccguacaagaccugggccuaccacggguccuacgaggugaaggccaccggcagcgccuccagcaugaucaacggggucgugaagcugcugaccaagcccugggacgucgugcccauggugacgcagauggcgaugaccgacaccacccccuucggccagcagcgcgucuucaaggagaagguggacacgcggaccccgcgcagcaugcccggcacccggcgcgugauggggaucaccgccgaguggcucuggcggacgcugggccgcaacaagaagccccggcugugcacccgcgaggaguucaccaagaagguccgcaccaacgccgccaugggggcgguguucacggaggagaaccagugggacuccgccaaggccgccguggaggacgaggacuucuggaagcucgucgaccgggagcgcgagcugcacaagcugggcaagugcgggagcugcguguacaacaugaugggcaagcgggagaagaagcucggcgaguucgggaaggccaagggcucccgcgcgaucugguacauguggcugggggcccgguaccuggaguucgaggcccucggcuuccugaacgaggaccacugguucagccgcgagaacuccuacagcgggguggagggcgagggccugcacaagcucggguacauccugcgggacaucuccaagauccccggcggggccauguacgccgacgacaccgcgggcugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucagccggaaggaccagcgcggguccggccagguggggacguacggccugaacaccuucaccaacauggaggcccagcucauccggcagauggagggggagggcgugcugagcaaggccgaccuggagaacccccaccucccggagaagaagaucacccaguggcuggagacgaagggcgucgagcgccugaagcggauggcgaucuccggggacgacugcguggugaagcccaucgacgaccgcuucgccaacgcccuccuggcccugaacgacaugggcaagguccggaaggacaucccccaguggcagcccagcaagggguggcacgacuggcagcaggucccguucugcucccaccacuuccacgagcucaucaugaaggacggccgcaagcuggugguccccugccggccccaggacgagcugaucgggcgcgcccggaucagccagggcgcgggcuggucccucaaggagaccgccugccuggggaaggccuacgcccagauguggagccugauguacuuccaccgccgcgaccuccggcuggcguccaacgccaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucggcaagcgcgaggaccaguggugcgggagccugaucggccugaccucccgggccacgugggcgcagaacaucccgaccgccauccagcagguccgcagccucaucgggaacgaggaguuccuggacuacaugcccuccaugaagcgguuccgcaaggaggaggagagcgagggcgccaucugguga

SEQ ID NO: 10022 - RNA, 9873 nt, Artificial Sequence
  derived and/or modified CDS sequence (opt1) from DENV-3__JN183884__SS-prME
accagccugugccucaugaugauccugcccgccgcccuggcguuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaagaugaagaacaaggccuggaugguccaccggcagugguucuucgaccugccccugcccuggaccagcggcgccaccaccgagacgcccaccuggaaccgcaaggagcuccuggugaccuucaagaacgcccacgccaagaagcaggagguggucgugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggaggucuccgagacccagcacgggaccauccucaucaagguggaguacaagggcgaggacgugccgugcaagauccccuucagcaccgaggacgggcagggcaaggcgcacaacggccgccugaucacggccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacaccgccugggacuucggguccgugggcggggugcucaacagccugggcaagaugguccaccagaucuucggguccgcguacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggccgacauggggugcgucaucaacuggaagggcaaggagcugaagugcggcagcgggaucuucgugacgaacgaggugcacaccuggaccgagcaguacaaguuccaggcggacucccccaagcgccucgccaccgccaucgccggcgccugggagaacggggucugcggcauccgcagcacgacccggauggagaaccugcuguggaagcagaucgcgaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagaccugcacguggccgaagucccacacccucuggagcaacggcgugcuggaguccgacaugaucauccccaagagccuggcggggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgccgggguguucuucaccuucguccugcuccuguccggccagaucaccuggcgcgacauggcgcacacccugaucaugaucggcagcaacgccuccgaccggauggggaugggcgugacguaccucgcccugaucgccaccuucaagauccagcccuuccuggcccucggguucuuccugcgcaagcugaccagccgggagaaccuccugcugggcgugggccucgcgauggccaccacgcugcagcugcccgaggacaucgagcagauggccaacgggaucgcccucggccugauggcgcugaagcucaucacccaguucgagaccuaccagcuguggaccgcccugaucagccucacgugcuccaacaccaucuucacccugaccgucgccuggcgcacggccacccugauccucgccggggugagccugcugccggucugccaguccagcuccaugcggaagaccgacuggcuccccauggcgguggccgccaugggcgugccgccccucccgcuguucaucuucgggcucaaggacacccugaagcgccgcagcuggccccugaacgagggcgucauggccgugggccucguguccauccuggccagcucccugcuccggaacgacguccccauggcggggccccugguggccggcgggcugcucaucgccugcuacgugaucacgggcaccagcgccgaccugaccgucgagaaggccgcggacaucaccugggaggaggaggccgagcagacgggggugucccacaaccugaugaucaccguggacgacgacggcaccaugcgcaucaaggacgacgagaccgagaacauccucaccguccugcugaagacggcccuccugaucgugagcggcaucuucccguacuccauccccgccacccugcucguguggcacaccuggcagaagcagacccagcggagcgggguccugugggacgugcccagcccgcccgagacgcagaaggccgagcuggaggagggcguguaccgcaucaagcagcaggggaucuucggcaagacccaggucggggugggcgugcagaaggagggcgucuuccacaccauguggcacgugacccgcggggcggugcucacguacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggaccuuccagaccacgaccggcgagaucggggcgaucgcccuggacuucaagcccggcaccuccggcagccccaucaucaaccgcgaggggaagguggugggccuguacgggaacggcgucgugaccaagaacgggggcuacgugagcggcaucgcccagacgaacgccgagccggacgggcccacccccgagcuggaggaggagauguucaagaagcggaaccucaccaucauggaccugcaccccggcuccgggaagacccgcaaguaccugccggccaucguccgggaggcgaucaagcgccggcuccgcacgcugauccuggcccccacccgggugguggccgccgagauggaggaggcccucaagggccugcccauccgcuaccagaccaccgcgaccaaguccgagcacaccgggcgggagaucgucgaccugaugugccacgccaccuucaccaugcgccuccugucccccgugcgggugccgaacuacaaccugaucaucauggacgaggcccacuucacggaccccgccagcaucgccgcgcgcggcuacaucuccacccgggucggcaugggggaggccgccgccaucuucaugaccgcgacgccgcccggcacggccgacgccuucccgcagagcaacgcccccauccaggacgaggagcgcgacauccccgagcgcuccuggaacagcgggaacgaguggaucaccgacuucgccggcaagaccgugugguucgugcccuccaucaaggcggggaacgacaucgccaacugccuccggaagaacggcaagaaggucauccagcugagccgcaagaccuucgacacggaguaccagaagaccaagcugaacgacugggacuucguggugaccaccgacaucuccgagaugggcgccaacuucaaggccgaccgggucaucgacccgcgccggugccucaagcccgugauccugacggacgggcccgagcgcgugauccuggccggccccaugccggucaccgcggccagcgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacccccgagggcaucaucccggcccucuucgagcccgagcgggagaaguccgccgccaucgacggcgaguaccgccugaagggggagagccggaagacguucguggagcugaugcgccggggcgaccuccccgucuggcuggcgcacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcaccuacagcgacccgcuggcccucaaggaguucaaggaguucgccgcggggcgcaaguccaucgcccuggaccuggugacggagaucggccgggugcccagccaccucgcccaccgcacccggaacgcccuggacaaccuggucaugcuccacaccuccgagcacgggggccgcgccuaccggcacgcgguggaggagcugcccgagaccauggagacgcugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgccuccgcgaucguccuggaguucuucaugauggugcuccugauccccgagcccgagaagcagcgcacgccccaggacaaccagcuggccuacguggucaucggcauccucacgcuggccgccaucaucgccgcgaacgagaugggccugcucgagaccaccaagcgggaccuggggaugagcaaggagccgggcguggugucccccaccagcuaccuggacgucgaccuccaccccgccuccgccuggacgcuguacgccguggcgaccaccgugaucacccccaugcugcgccacacgaucgagaacagcaccgccaacgucucccucgccgccaucgccaaccaggcgguggugcugauggggcuggacaagggcuggccgaucagcaagauggaccucggggucccccugcuggcccucggcugcuacucccaggugaacccccugacccugaccgccgccgugcuccugcugaucacgcacuacgccaucaucggccccgggcuccaggcgaaggccacccgggaggcccagaagcgcaccgccgccggcaucaugaagaacccgaccgucgacgggaucaugacgaucgaccuggaccccgugaucuacgacagcaaguucgagaagcagcugggccaggugaugcuccugguccugugcgcggugcagcuccugcugaugcggaccuccugggcccucugcgaggcccugacccuggccaccggccccaucacgacccucugggaggggagccccggcaaguucuggaacaccaccaucgcgguguccauggccaacaucuuccgcgggagcuaccuggccggcgccgggcuggccuucuccaucaugaaguccgucggcacgggcaagcgggggaccggcucccagggggagacccucggcgagaaguggaagaagaagcugaaccagcugagccgcaaggacuucgaccucuacaagaaguccgggaucaccgagguggaccggaccgaggcgaaggagggccugaagcgcggcgagaucacgcaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacaccaagggcgggcccggccacgaggagcccgugcccaugagcaccuacggguggaacaucgucaagcugauguccggcaaggacguguucuaccucccgcccgagaagugcgacacgcugcugugcgacaucggcgagagcucccccagccccaccguggaggagucccgcaccauccgcguccugaagaugguggagccguggcucaagaacaaccaguucugcaucaaggugcugaaccccuacaugcccaccgucaucgagcaccuggagcggcuccagcgcaagcacgggggcaugcuggugcggaacccccugagccgcaacuccacgcacgagauguacuggaucagcaacgggaccggcaacaucguggccuccgucaacauggugagccggcuccugcugaaccgcuucaccaugacccaccggcgcccgacgaucgagaaggacguggaccucggcgcggggacccggcacgucaacgccgagcccgagacccccaacauggacgugaucggcgagcgcaucaagcggaucaaggaggagcacaacuccaccuggcacuacgacgacgagaacccguacaagacgugggccuaccacgggagcuacgaggugaaggccaccggcuccgccagcuccaugaucaacggggucgugaagcugcugaccaagcccugggacgucgugcccauggugacccagauggcgaugacggacaccacccccuucggccagcagcgcgucuucaaggagaagguggacacccggacgccgcgcagcaugcccggcacccggcgcgugauggggaucaccgccgaguggcucuggcggacccugggccgcaacaagaagccccggcugugcacgcgcgaggaguucaccaagaagguccgcaccaacgccgccaugggggcgguguucaccgaggagaaccagugggacagcgccaaggccgccguggaggacgaggacuucuggaagcucgucgaccgggagcgcgagcugcacaagcugggcaagugcggguccugcguguacaacaugaugggcaagcgggagaagaagcucggcgaguucgggaaggccaagggcagccgcgcgaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgccgacgacacggcgggcugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucucccggaaggaccagcgcgggagcggccagguggggaccuacggccugaacacguucaccaacauggaggcccagcucauccggcagauggagggggagggcgugcuguccaaggccgaccuggagaacccccaccucccggagaagaagaucacccaguggcuggagaccaagggcgucgagcgccugaagcggauggcgaucagcggggacgacugcguggugaagcccaucgacgaccgcuucgccaacgcccuccuggcccugaacgacaugggcaagguccggaaggacaucccccaguggcagcccuccaagggguggcacgacuggcagcaggucccguucugcagccaccacuuccacgagcucaucaugaaggacggccgcaagcuggugguccccugccggccccaggacgagcugaucgggcgcgcccggaucucccagggcgcgggcuggagccucaaggagacggccugccuggggaaggccuacgcccagauguggucccugauguacuuccaccgccgcgaccuccggcuggcgagcaacgccaucugcuccgccgugcccgugcacugggucccgaccagccgcaccaccugguccauccacgcccaccaccaguggaugacgaccgaggacaugcugaccguguggaaccggguguggaucgaggacaaccccuggauggaggacaagacccccgucacgaccugggagaacgugcccuaccucggcaagcgcgaggaccaguggugcgggagccugaucggccugaccagccgggccaccugggcgcagaacaucccgacggccauccagcagguccgcucccucaucgggaacgaggaguuccuggacuacaugcccagcaugaagcgguuccgcaaggaggaggaguccgagggcgccaucugguga

SEQ ID NO: 10023 - RNA, 9873 nt, Artificial Sequence
  derived and/or modified CDS sequence (opt1) from DENV-3__HQ541785__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacaucacgugggaggaggaggccgagcagaccggcgugagccacaaccugaugaucgccguggacgacgacgggaccaugcgcaucaaggacgacgagaccgagaacauccucaccguccugcugaagacggcccuccugaucguguccggcaucuucccguacagcauccccgccacccugcucguguggcacaccuggcagaagcagacccagcgguccggcguccugugggacgugcccagcccgcccgagacgcagaaggcggagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggcgaucguccgggaggccaucaagcgccggcuccgcacgcugauccuggcccccacccgggugguggccgccgagauggaggaggcgcucaaggggcugcccauccgcuaccagaccaccgccacgaaguccgagcacaccggccgggagaucgucgaccugaugugccacgccaccuucaccaugcgccuccugagccccgugcgggugccgaacuacaaccugaucaucauggacgaggcccacuucacggaccccgccuccaucgcggcccgcggguacaucagcacccgggucggcaugggcgaggccgccgcgaucuucaugaccgccacgccgcccgggacggccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagacguucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggaguucgcggccggccgcaagagcaucgcccuggaccuggugacggagaucgggcgggugcccucccaccucgcccaccgcacccggaacgcccuggacaaccuggucaugcuccacaccagcgagcacggcgggcgcgcguaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgugaucaccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagaccaccaagcgggaccugggcauguccaaggagccggggguggugagccccacguccuaccuggacgucgaccuccaccccgccagcgccuggacccuguacgccguggcgaccaccgugaucacgcccaugcugcgccacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugacggccgccgugcuccugcugaucacccacuacgccaucaucggccccggccuccaggcgaaggccacccgggaggcccagaagcgcaccgccgccgggaucaugaagaacccgacggucgacggcaucaugaccaucgaccuggaccccgugaucuacgacuccaaguucgagaagcagcugggccaggugaugcuccugguccugugcgcggugcagcuccugcugaugcggaccagcugggcccucugcgaggcccugacccuggccacgggccccaucaccacccucugggagggcucccccgggaaguucuggaacaccacgaucgcggugagcauggccaacaucuuccgcggcuccuaccuggccggggccggccuggccuucagcaucaugaaguccgucgggaccggcaagcggggcaccgggagccagggcgagacccucggggagaaguggaagaagaagcugaaccagcugagccgcaaggacuucgaccucuacaagaaguccggcaucaccgagguggaccggacggaggcgaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccgcaccauccgcguccugaagaugguggagccguggcucaagaacaaccaguucugcaucaaggugcugaaccccuacaugcccacggucaucgagcaccuggagcggcuccagcgcaagcacggcgggaugcuggugcggaacccccugucccgcaacagcacccacgagauguacuggaucuccaacggcaccgggaacaucguggccagcgucaacauggugucccggcuccugcugaaccgcuucaccaugacgcaccggcgcccgaccaucgagaaggacguggaccucggcgcgggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgucgugcccauggugacgcagauggcgaugaccgacaccacccccuucgggcagcagcgcgucuucaaggagaagguggacacgcggaccccgcgcagcaugcccggcacccggcgcgugaugggcaucaccgccgaguggcucuggcggacgcuggggcgcaacaagaagccccggcugugcacccgcgaggaguucaccaagaagguccgcaccaacgccgccaugggcgcgguguucacggaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcccagcucauccggcagauggagggcgagggggugcugagcaaggccgaccuggagaacccccaccucccggagaagaagaucacccaguggcuggagacgaagggcgucgagcgccugaagcggauggcgaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggcgggcuggucccucaaggagaccgccugccugggcaaggccuacgcccagauguggagccugauguacuuccaccgccgcgaccuccggcuggcguccaacgccaucugcagcgccgugcccgugcacugggucccgaccucccgcaccacguggagcauccacgcccaccaccaguggaugaccaccgacgacaugcugaccguguggaaccggguguggaucgaggacaaccccuggauggaggacaagacgcccgucaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10024 - RNA, 9873 nt, Artificial Sequence
  derived and/or modified CDS sequence (opt1) from DENV-3__HM181975__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagaccugggcccugcgccacccgggguucaccauccucgcgcuguuccuggcccacuacaucggcaccucccucacccagaagguggugaucuucguccugcugaugcucgugacgcccagcaugaccaugcggugcgugggggucggcaaccgcgacuucguggagggccuguccggggccaccuggguggacgucgugcuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcagcacgagaaccucaaguacacggugaucaucaccguccacaccggggaccagcaccaggugggcaacgagacccagggggucacggccgagaucacgccccaggccagcaccaccgaggcgauccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgucccgugcaagauccccuucagcacggaggacgggcagggcaaggcgcacaacggccgccugaucaccgccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacacggccugggacuucggguccgugggcgggguccucaacagccugggcaagauggugcaccagaucuucggguccgcguacaccgcccuguucagcggcguguccugggucaugaagaucggcaucggggugcuccugaccuggaucggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgugucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagacgugcaccuggccgaagucccacacccucuggagcaacggcguccuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccguggugaucaccgagaacugcgggacgcgcggccccagccuccggaccaccaccgucuccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaaggucgacaacuucaccaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgucggccucgcgauggccacgacccugcagcugcccgaggacaucgagcagauggccaacgggaucgcccucggccugauggcgcugaagcucaucacccaguucgagaucuaccagcuguggaccgcccugaucagccucacgugcuccaacaccaucuucacccugaccguggccuggcgcacggccacccugauccucgccggggucagccugcugccgaugugccaguccagcuccaugcggaagaccgacuggcuccccauggcgguggccgccaugggcgugccgccccucccgcuguucaucuucagccucaaggacacccugaagcgccgcuccuggccccugaacgagggggucauggccgugggccucgugagcauccuggccuccagccugcuccggaacgacguccccauggcgggcccccugguggccgggggccugcucaucgccugcuacgugaucacggggaccuccgccgaccugaccgucgagaaggccgcggacaucaccugggaggaggaggccgagcagacgggcgugagccacaaccugaugaucaccguggacgacgacgggaccaugcgcaucaaggacgacgagaccgagaacauccucaccguccugcugaagacggcccuccugaucguguccggcaucuucccguacagcauccccgccacccugcucguguggcacaccuggcagaagcagacccagcgguccggcguccugugggacgugcccagcccgcccgagacgcagaaggccgagcuggaggaggggguguaccgcaucaagcagcagggcaucuucgggaagacccaggucggcgugggggugcagaaggagggcgucuuccacaccauguggcacgugacccggggcgcggugcucacguacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcaccuuccagaccacgaccggggagaucggcgcgaucgcccuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggccaucguccgggaggcgaucaagcgccggcuccgcacgcugauccuggcccccacccgggugguggccgccgagauggaggaggcccucaaggggcugcccauccgcuaccagaccaccgcgacgaaguccgagcacaccggccgggagaucgucgaccugaugugccacgccaccuucaccaugcgccuccugagccccgugcgggugccgaacuacaaccugaucaucauggacgaggcccacuucacggaccccgccuccaucgccgcgcgcggguacaucagcacccgggucggcaugggcgaggccgccgccaucuucaugaccgcgacgccgcccgggacggccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagucccggaagacguucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggaguucgccgcgggccgcaagagcaucgcccuggaccuggugacggagaucgggcgggugcccucccaccucgcccaccgcacccggaacgcccuggacaaccuggucaugcuccacaccagcgagcacggcgggcgcgccuaccggcacgcgguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacgcuggccgccaucaucgccgcgaacgagaugggccugcucgagaccaccaagcgggaccugggcauguccaaggagccggggguggugagccccaccuccuaccuggacgucgaccuccaccccgccagcgccuggacgcuguacgccguggcgaccaccgugaucacccccaugcugcgccacacgaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugaccgccgccgugcuccugcugaucacgcacuacgccaucaucggccccggccuccaggcgaaggccacccgggaggcccagaagcgcaccgccgccgggaucaugaagaacccgaccgucgacggcaucaugacgaucgaccuggaccccgugaucuacgacuccaaguucgagaagcagcugggccaggugaugcuccugguccugugcguggugcagcuccugcugaugcggaccagcugggcgcucugcgaggcccugacccuggccaccggccccaucacgacccucugggagggcucccccgggaaguucuggaacaccaccaucgccgucagcauggcgaacaucuuccgcggcuccuaccuggccggggccggccuggccuucagcaucaugaaguccguggggacgggcaagcggggcaccgggagccagggcgagacccucggggagaaguggaagaagaagcugaaccagcugagccgcaaggacuucgaccucuacaagaaguccggcaucaccgagguggaccggaccgaggccaaggaggggcugaagcgcggcgagaucacgcaccacgcggucagccggggcuccgccaagcugcagugguucguggagcgcaacauggugaucccggaggggcgggucaucgaccucggcugcgggcgcggcggguggagcuacuacugcgccggccugaagaaggugaccgaggugcggggcuacaccaagggcgggcccgggcacgaggagcccguccccauguccaccuacggcuggaacaucgugaagcugaugagcgggaaggacguguucuaccucccgcccgagaagugcgacacgcugcugugcgacaucggcgaguccagccccucccccaccgucgaggagagccgcaccauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugucccgcaacagcacgcacgagauguacuggaucuccaacggcaccgggaacaucgucgccagcgugaacauggugucccggcuccugcugaaccgcuucaccaugauccaccggcgcccgaccaucgagaaggacgucgaccucggcgccggcacgcggcacgugaacgcggagcccgagacccccaacauggacgugaucggggagcgcaucaagcggaucaaggaggagcacaacagcaccuggcacuacgacgacgagaacccguacaagaccugggccuaccacggcuccuacgaggucaaggccacggggagcgccuccagcaugaucaacggcguggucaagcugcugaccaagcccugggacguggugcccauggucacccagauggccaugaccgacacgacccccuucgggcagcagcgcguguucaaggagaagguggacacccggaccccgcgcagcaugcccggcacgcggcgcgucaugggcaucaccgcggaguggcucuggcggacccuggggcgcaacaagaagccccggcugugcacccgcgaggaguucacgaagaaggugcgcaccaacgccgccaugggcgccguguucaccgaggagaaccagugggacuccgcgaaggccgccgucgaggacgaggacuucuggaagcucguggaccgggagcgcgagcugcacaagcuggggaagugcggcagcugcguguacaacaugauggggaagcgggagaagaagcucggcgaguucggcaaggccaaggggucccgcgccaucugguacauguggcugggcgcgcgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgccgacgacaccgccgggugggacacgcgcaucaccgaggacgaccugcacaacgaggagaagaucacccagcagauggacccggagcaccggcagcucgcgaacgccaucuucaagcugaccuaccagaacaagguggugaagguccagcgccccacgcccaccggcaccgugauggacaucaucagccggaaggaccagcgcggcuccggccaggugggcaccuacgggcugaacaccuucacgaacauggaggcccagcucauccggcagauggagggcgaggggguccugagcaaggccgaccuggagaacccccaccucccggagaagaagaucacccaguggcuggagaccaagggcguggagcgccugaagcggauggccaucuccggcgacgacugcguggucaagcccaucgacgaccgcuucgcgaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcccggaucagccagggggccggcuggucccucaaggagaccgcgugccugggcaaggccuacgcccagauguggagccugauguacuuccaccgccgcgaccuccggcuggccuccaacgcgaucugcagcgccgugcccguccacugggugccgacgucccgcaccaccuggagcauccacgcccaccaccaguggaugaccacggaggacaugcugaccguguggaaccgggucuggaucgaggacaaccccuggauggaggacaagacccccgugaccacgugggagaacgugcccuaccucgggaagcgcgaggaccaguggugcggcagccugaucgggcugaccucccgggccaccugggcccagaacaucccgaccgcgauccagcagguccgcagccucaucggcaacgaggaguuccuggacuacaugcccuccaugaagcgguuccgcaaggaggaggagagcgagggggccaucugguga

SEQ ID NO: 10025 - RNA, 9873 nt, Artificial Sequence
  derived and/or modified CDS sequence (opt1) from DENV-3__HM631864__SS-prME
accagccucugccucaugaugauccugcccgccgcccuggcguuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagaaggccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccgcccgggcuaccacacccagacggccgggcccuggcaccucggcaagcuggagcuggacuucaacuacugcgagggcaccaccgucgugaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccugguguccgccggcagcgggaagguggacaacuccaccaugggcguccugugccucgccauccuguucgaggaggugaugcgcgggaaguucggcaagaagcacaugaucgccgggguguucuucaccuucguccugcuccugagcggccagaucaccuggcgggacauggcgcacacgcugaucaugaucggcuccaacgccagcgaccgcauggggaugggcgugaccuaccucgcccugaucgccaccuucaagauccagcccuuccuggcccucggguucuuccugcggaagcugaccagccgcgagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucucccugaccugcagcaacaccaucuucacccugacggucgccuggcggaccgccacccugauccucgccggggugucccugcugccggucugccagagcuccagcaugcgcaagaccgacuggcuccccauggcgguggccgccaugggcgugccgccccucccgcuguucaucuucucccucaaggacacgcugaagcggcgcagcuggccccugaacgagggggucauggccgugggccucguguccauccuggccagcucccugcuccgcaacgacguccccauggcgggcccccugguggccgggggccugcucaucgccugcuacgugaucaccgggaccagcgccgaccugaccgucgagaaggccgcggacaucacgugggaggaggaggccgagcagaccggcgugucccacaaccugaugaucgccguggacgacgacgggaccaugcggaucaaggacgacgagaccgagaacauccucaccguccugcugaagacggcccuccugaucgugagcggcaucuucccguacuccauccccgccacccugcucguguggcacaccuggcagaagcagacccagcgcagcggcguccugugggacgugcccagcccgcccgagacgcagaaggcggagcuggaggaggggguguaccggaucaagcagcagggcaucuucgggaagacccaggucggcgugggggugcagaaggagggcgucuuccacaccauguggcacgugacccgcggcgccgugcucacguacaacgggaagcggcuggagcccaacugggccagcgucaagaaggaccugaucuccuacggcgggggcuggcgccucagcgcccaguggcagaagggggaggagguccaggugaucgcggucgagcccggcaagaaccccaagaacuuccagaccaugcccggcaccuuccagaccacgaccggggagaucggcgccaucgcccuggacuucaagcccgggaccagcggcucccccaucaucaaccgggagggcaaggugguggggcuguacggcaacggggucgugaccaagaacggcggguacgugagcggcaucgcccagacgaacgccgagccggacggccccacccccgagcuggaggaggagauguucaagaagcgcaaccucaccaucauggaccugcaccccggguccggcaagacccggaaguaccugccggcgaucguccgcgaggccaucaagcggcgccuccggacgcugauccuggcccccacccgcgugguggccgccgagauggaggaggcgcucaaggggcugcccauccgguaccagaccaccgccaccaaguccgagcacaccggccgcgagaucgucgaccugaugugccacgccaccuucaccaugcggcuccugucccccgugcgcgugccgaacuacaaccugaucaucauggacgaggcccacuucacggaccccgccagcaucgcggcccggggguacaucuccacccgcgucggcaugggcgaggccgccgcgaucuucaugaccgccacgccgcccgggacggccgacgccuucccgcagagcaacgcccccauccaggacgaggagcgggacauccccgagcgcuccuggaacagcggcaacgaguggaucaccgacuucgcggggaagaccgugugguucgugcccuccaucaaggccggcaacgacaucgccaacugccuccgcaagaacgggaagaaggucauccagcugagccggaagaccuucgacacggaguaccagaagaccaagcugaacgacugggacuucguggugaccaccgacaucuccgagaugggcgccaacuucaaggccgaccgcgucaucgacccgcggcgcugccucaagcccgugauccugacggacggccccgagcgggugauccuggcggggcccaugccggucaccgccgccagcgccgcccagcgccggggccgcguggggcggaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgcgagaaguccgccgcgaucgacggcgaguaccggcugaagggcgagagccgcaagacguucguggagcugaugcggcgcggggaccuccccgucuggcuggcccacaagguggccuccgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccggaccuacagcgacccgcuggcccucaaggaguucaaggaguucgcggccggccgcaaguccaucgcccuggaccuggugacggagaucgggcgcgugcccagccaccucgcccaccggacccgcaacgcccuggacaaccuggucaugcuccacaccagcgagcacggcgggcgggcguaccgccacgccguggaggagcugcccgagaccauggagacgcugcuccugcugggccucaugauccugcugaccgggggcgccaugcuguuccugaucuccggcaaggggaucggcaagaccagcaucgggcugaucugcgugaucgccuccagcggcaugcucuggauggccgagaucccgcugcaguggaucgcguccgccaucguccuggaguucuucaugauggugcuccugauccccgagcccgagaagcagcggacgccccaggacaaccagcuggccuacguggucaucgggauccucacgcuggccgccgugaucgcggccaacgagaugggccugcucgagaccaccaagcgcgaccugggcaugagcaaggagccggggguggucucccccaccagcuaccuggacguggaccuccaccccgccuccgccuggacgcuguacgcgguggccaccaccgucaucacccccaugcugcggcacacgaucgagaacagcaccgccaacgugucccucgccgccaucgcgaaccaggccgugguccugaugggccuggacaagggguggccgaucagcaagauggaccucggcgugccccugcuggcccucgggugcuacucccaggugaacccccugacccugaccgccgccguccuccugcugaucacgcacuacgcgaucaucggccccggccuccaggccaaggccacccgcgaggcccagaagcggaccgccgcggggaucaugaagaacccgaccguggacggcaucaugacgaucgaccuggaccccgugaucuacgacagcaaguucgagaagcagcuggggcaggucaugcuccuggugcugugcgccgugcagcuccugcugaugcgcaccuccugggcccucugcgaggcccugacccuggcgaccggccccaucacgacccucugggagggcagccccgggaaguucuggaacaccaccaucgccgucuccauggccaacaucuuccggggcagcuaccuggccggggccggccuggcguucuccaucaugaaguccguggggacgggcaagcgcggcaccgggagccagggcgagacccucggggagaaguggaagaagaagcugaaccagcugucccggaaggacuucgaccucuacaagaaguccggcaucaccgagguggaccgcaccgaggccaaggaggggcugaagcggggcgagaucacgcaccacgccgucucccgcggcagcgccaagcugcagugguucguggagcggaacauggugaucccggaggggcgcgucaucgaccucggcugcgggcggggcgggugguccuacuacugcgccggccugaagaaggugaccgaggugcgcggcuacaccaagggcgggcccgggcacgaggagcccguccccaugagcaccuacggcuggaacaucgugaagcugauguccgggaaggacguguucuaccucccgcccgagaagugcgacacgcugcugugcgacaucggcgagagcucccccagccccaccgucgaggagucccggaccauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacgcacgagauguacuggaucagcaacggcaccgggaacaucgucgcguccgugaacauggugagccgccuccugcugaaccgguucaccaugacccaccgccggccgacgaucgagaaggacgucgaccucggcgccggcacccgccacgugaacgccgagcccgagacccccaacauggacgugaucggggagcggaucaagcgcaucaaggaggagcacaacuccaccuggcacuacgacgacgagaacccguacaagacgugggccuaccacggcagcuacgaggucaaggccaccggguccgcgagcagcaugaucaacggcguggucaagcugcugaccaagcccugggacguggugcccauggucacccagauggccaugacggacaccacccccuucgggcagcagcggguguucaaggagaagguggacacccgcacgccgcgguccaugcccggcacccgccgggucaugggcaucaccgccgaguggcucuggcgcacccuggggcggaacaagaagccccgccugugcacgcgggaggaguucaccaagaaggugcgcaccaacgccgcgaugggcgccguguucaccgaggagaaccagugggacagcgccaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggcgaaggggagccgggccaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgcggacgacacggccgggugggacacccggaucaccgaggacgaccugcacaacgaggagaagaucacccagcagauggacccggagcaccgccagcucgccaacgccaucuucaagcugacguaccagaacaagguggugaagguccagcggcccacccccaccggcaccgugauggacaucaucucccgcaaggaccagcggggcagcggccaggugggcaccuacgggcugaacacguucaccaacauggaggcccagcucauccgccagauggagggcgaggggguccuguccaaggcggaccuggagaacccccaccucccggagaagaagaucacccaguggcuggagaccaagggcguggagcggcugaagcgcauggccaucagcggcgacgacugcguggucaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcgcgcaucucccagggggccggcuggagccucaaggagacggccugccugggcaaggccuacgcgcagauguggucccugauguacuuccaccggcgcgaccuccgccuggccagcaacgccaucugcuccgccgugcccguccacugggugccgaccagccggaccaccuggagcauccacgcccaccaccaguggaugacgaccgacgacaugcugaccguguggaaccgcgucuggaucgaggacaaccccuggauggaggacaagacccccgugacgaccugggagaacgugcccuaccucgggaagcgggaggaccaguggugcggcucccugaucgggcugaccagccgcgcgaccugggcccagaacaucccgacggccauccagcagguccggucccucaucggcaacgaggaguuccuggacuacaugcccagcaugaagcgcuuccggaaggaggaggaguccgagggggccaucugguga

SEQ ID NO: 10026 - RNA, 9873 nt, Artificial Sequence
  derived and/or modified CDS sequence (opt1) from DENV-3__HM631859__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaucuaccagcuguggaccgcccugaucagccucacgugcuccaacaccaucuucacccugaccgucgccuggcgcacggccacccugauccucgccggggugagccugcugccgaugugccaguccagcuccaugcggaagaccgacuggcuccccauggcggucgccgccaugggcgugccgccccucccgcuguucaucuucagccucaaggacacccugaagcgccgcuccuggccccugaacgagggggugauggccgucggccucgugagcauccuggccuccagccugcuccggaacgacgugcccauggcgggcccccuggucgccgggggccugcucaucgccugcuacgugaucacggggaccuccgccgaccugaccguggagaaggccgcggacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcaucuucccguacagcauccccgccacccugcucguguggcacaccuggcagaagcagacccagcgguccggcgugcugugggacguccccagcccgcccgagacgcagaaggccgagcuggaggaggggguguaccgcaucaagcagcagggcaucuucgggaagacccaggugggcgucggggugcagaaggagggcguguuccacaccauguggcacgucacccggggcgcggugcucacguacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagaccacgaccggggagaucggcgcgaucgcccuggacuucaagcccgggaccagcggcagccccaucaucaaccgcgagggcaaggucguggggcuguacggcaacgggguggucaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggccaucgugcgggaggcgaucaagcgccggcuccgcacgcugauccuggcccccacccgggucguggccgccgagauggaggaggcccucaaggggcugcccauccgcuaccagaccaccgcgacgaaguccgagcacaccggccgggagaucguggaccugaugugccacgccaccuucaccaugcgccuccugagccccguccgggugccgaacuacaaccugaucaucauggacgaggcccacuucacggaccccgccuccaucgccgcgcgcggguacaucagcacccgggugggcaugggcgaggccgccgccaucuucaugaccgcgacgccgcccgggacggccgacgccuucccgcaguccaacgcccccauccaggacgaggagcgcgacauccccgagcgcagcuggaacuccggcaacgaguggaucaccgacuucgccgggaagaccgucugguucgugcccagcaucaaggcgggcaacgacaucgccaacugccuccggaagaacgggaagaaggugauccagcugucccgcaagaccuucgacacggaguaccagaagaccaagcugaacgacugggacuucgucgugaccaccgacaucagcgagaugggcgccaacuucaaggccgaccgggugaucgacccgcgccggugccucaagcccgucauccugacggacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagucccggaagacguucguggagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcccucaaggaguucaaggaguucgccgcgggccgcaagagcaucgcccuggaccuggucacggagaucgggcgggugcccucccaccucgcccaccgcacccggaacgcccuggacaaccuggugaugcuccacaccagcgagcacggcgggcgcgccuaccggcacgcggucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcgcacgccccaggacaaccagcuggccuacguggugaucgggauccucacgcuggccgccaucaucgccgcgaacgagaugggccugcucgagaccaccaagcgggaccugggcauguccaaggagccgggggucgugagccccaccuccuaccuggacguggaccuccaccccgccagcgccuggacgcuguacgccgucgcgaccaccgugaucacccccaugcugcgccacacgaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugaccgccgccgugcuccugcugaucacgcacuacgccaucaucggccccggccuccaggcgaaggccacccgggaggcccagaagcgcaccgccgccgggaucaugaagaacccgaccguggacggcaucaugacgaucgaccuggaccccgucaucuacgacuccaaguucgagaagcagcugggccaggugaugcuccuggugcugugcgucgugcagcuccugcugaugcggaccagcugggcgcucugcgaggcccugacccuggccaccggccccaucacgacccucugggagggcucccccgggaaguucuggaacaccaccaucgccgugagcauggcgaacaucuuccgcggcuccuaccuggccggggccggccuggccuucagcaucaugaaguccgucgggacgggcaagcggggcaccgggagccagggcgagacccucggggagaaguggaagaagaagcugaaccagcugagccgcaaggacuucgaccucuacaagaaguccggcaucaccgagguggaccggaccgaggccaaggaggggcugaagcgcggcgagaucacgcaccacgcggugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacgcacgagauguacuggaucuccaacggcaccgggaacaucguggccagcgucaacauggugucccggcuccugcugaaccgcuucaccaugacccaccggcgcccgacgaucgagaaggacguggaccucggcgccggcacccggcacgucaacgcggagcccgagacccccaacauggacgugaucggggagcgcaucaagcggaucaaggaggagcacaacagcaccuggcacuacgacgacgagaacccguacaagacgugggccuaccacggcuccuacgaggugaaggccaccgggagcgccuccagcaugaucaacggcgucgugaagcugcugaccaagcccugggacgucgugcccauggugacccagauggccaugacggacaccacccccuucgggcagcagcgcgucuucaaggagaagguggacacccggacgccgcgcagcaugcccggcacccggcgcgugaugggcaucaccgcggaguggcucuggcggacccuggggcgcaacaagaagccccggcugugcacgcgcgaggaguucaccaagaagguccgcaccaacgccgccaugggcgccguguucaccgaggagaaccagugggacuccgcgaaggccgccguggaggacgaggacuucuggcggcucgucgaccgcgagcgggagcugcacaagcuggggaagugcggcagcugcguguacaacaugauggggaagcgcgagaagaagcucggcgaguucggcaaggccaaggggucccgggccaucugguacauguggcugggcgcgcgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacacggccgggugggacacccggaucaccgaggacgaccugcacaacgaggagaagaucacccagcagauggacccggagcaccgccagcucgcgaacgccaucuucaagcugacguaccagaacaaggucgugaaggugcagcggcccacccccaccggcaccgucauggacaucaucagccgcaaggaccagcggggcuccggccaggugggcaccuacgggcugaacacguucaccaacauggaggcccagcucauccgccagauggagggcgagggggugcugagcaaggccgaccuggagaacccccaccucccggagaagaagaucacccaguggcuggagaccaagggcgucgagcggcugaagcgcauggccaucuccggcgacgacugcguggugaagcccaucgacgaccgguucgcgaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggccggcuggucccucaaggagacggcgugccugggcaaggccuacgcccagauguggagccugauguacuuccaccgccgggaccuccgccuggccuccaacgcgaucugcagcgccgugcccgugcacugggucccgaccucccggaccaccuggagcauccacgcccaccaccaguggaugacgaccgaggacaugcugaccguguggaaccgcguguggaucgaggacaaccccuggauggaggacaagacccccgucacgaccugggagaacgugcccuaccucgggaagcgggaggaccaguggugcggcagccugaucgggcugaccucccgcgccaccugggcccagaacaucccgacggcgauccagcagguccggagccucaucggcaacgaggaguuccuggacuacaugcccuccaugaagcgcuuccggaaggaggaggagagcgagggggccaucugguga

SEQ ID NO: 10027 - RNA, 9870 nt, Artificial Sequence
  derived and/or modified CDS sequence (opt1) from DENV-3__HM631856__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucgugaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgaaggagcugaaguacuccuggaagaccugggggaaggccaagaucgucaccgccgagacgcagaacagcuccuucaucaucgacggccccaacacccccgagugccccagcgugucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagacgugcaccuggccgaagucccacacccucuggagcaacggcguccuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccguggugaucaccgagaacugcgggacgcgcggccccagccuccggaccaccaccgucuccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaaggucgacaacuucaccaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgucggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacgguggccuggcgcaccgccacccugauccucgccggggucagccugcugccggugugccaguccagcuccaugcggaagaccgacuggcuccccauggcgguggccgccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacaucacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguuccggaagcgcaaccucaccaucauggaccugcaccccgggagcggcaagacgcggaaguaccugccggccaucgugcgcgaggcgaucaagcggcgccuccggacccugauccuggcccccacccgcguggucgccgccgagauggaggaggcccucaaggggcugcccauccgguaccagaccacggcgaccaaguccgagcacaccggccgcgagaucguggaccugaugugccacgccaccuucacgaugcggcuccugagccccgugcgcgucccgaacuacaaccugaucaucauggacgaggcccacuucaccgaccccgccuccaucgccgcgcggggguacaucagcacccgcgugggcaugggcgaggccgccgccaucuucaugaccgcgacgccgcccgggaccgccgacgccuucccgcaguccaacgcccccauccaggacgaggagcgcgacauccccgagcggagcuggaacuccggcaacgaguggaucaccgacuucgccgggaagaccgugugguucguccccagcaucaaggcgggcaacgacaucgccaacugccuccgcaagaacgggaagaaggugauccagcugucccggaagacguucgacaccgaguaccagaagaccaagcugaacgacugggacuucguggucaccacggacaucagcgagaugggcgccaacuucaaggccgaccgcgugaucgacccgcggcgcugccucaagcccgugauccugaccgacggccccgagcgggucauccuggccgggcccaugccggugaccgcggccuccgccgcccagcgccggggccgcguggggcggaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgcgagaaguccgccgccaucgacggcgaguaccggcugaagggcgagucccgcaagaccuucgucgagcugaugcggcgcggggaccuccccguguggcuggcgcacaaggucgccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcacguacuccgacccgcuggcccucaaggaguucaaggaguucgccgcgggccgcaagagcaucgcccuggaccuggugaccgagaucgggcgcguccccucccaccucgcccaccggacccgcaacgcccuggacaaccuggugaugcuccacaccagcgagcacggcgggcgggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccaccaagcgcgaccugggcauguccaaggagccggggguggucagccccacguccuaccuggacguggaccuccaccccgccagcgccuggacccuguacgccguggcgaccaccgucaucacgcccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgcgaggcccagaagcggaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacccuggccacgggccccaucaccacccucugggagggcucccccgggaaguucuggaacaccacgaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggacuucgaccucuacaagaaguccggcaucaccgagguggaccgcacggaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccgcaccauccgggugcugaagaugguggagccguggcucaagaacaaccaguucugcaucaagguccugaaccccuacaugcccacggugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucaccaugacgcaccgccggccgaccaucgagaaggacgucgaccucggcgcgggcacccgccacgugaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcggguguucaaggagaagguggacacgcgcaccccgcggagcaugcccggcacccgccgggucaugggcaucaccgccgaguggcucuggcgcacgcuggggcggaacaagccccgccugugcacccgcgaggaguucaccaagaaggugcggaccaacgccgccaugggcgcgguguucacggaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucagccgcaaggaccagcggggcuccggccaggugggcacguacgggcugaacaccuucaccaacauggaggcccagcucauccgccagauggagggcgaggggguccugagcaaggccgaccuggagaacccccaccucccggagaagaagaucacccaguggcuggagacgaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccucaaggagaccgccugccugggcaaggccuacgcccagauguggagccugauguacuuccaccgccgggaccuccgccuggcguccaacgccaucugcagcgccgugcccguccacugggugccgaccucccggaccacguggagcauccacgcccaccaccaguggaugaccaccgaggacaugcugaccguguggaaccgcgucuggaucgaggacaaccccuggauggaggacaagacgcccgugaccaccugggagaacgugcccuaccucgggaagcgggaggaccaguggugcggcagccugaucgggcugaccucccgcgccacgugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 10028 - RNA, 9873 nt, Artificial Sequence
  derived and/or modified CDS sequence (opt1) from DENV-3__HM756276__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucgugaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgugucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagacgugcaccuggccgaagucccacacccucuggagcaacggcguccuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccguggugaucaccgagaacugcgggacgcgcggccccagccuccggaccaccaccgucuccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaaggucgacaacuucaccaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgucggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacgguggccuggcgcaccgccacccugauccucgccggggucagccugcugccggugugccaguccagcuccaugcggaagaccgacuggcuccccauggcgguggccgccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacaucacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggaguucgccgcgggccgcaagagcaucgcccuggaccuggugaccgagaucgggcggguccccucccaccucgcccaccgcacccggaacgcccuggacaaccuggugaugcuccacaccagcgagcacggcgggcgcgccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcgcacgccccaggacaaccagcuggccuacgucgugaucgggauccucacccuggccgccaucaucgccgcgaacgagaugggccugcucgagaccaccaagcgggaccugggcauguccaaggagccggggguggucagccccacguccuaccuggacguggaccuccaccccgccagcgccuggacccuguacgccguggcgaccaccgucaucacgcccaugcugcgccacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgggaggcccagaagcgcaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcggaccagcugggcccucugcgaggcccugacccuggccacgggccccaucaccacccucugggagggcucccccgggaaguucuggaacaccacgaucgcggucagcauggccaacaucuuccgcggcuccuaccuggccggggccggccuggccuucagcaucaugaaguccguggggaccggcaagcggggcaccgggagccagggcgagacccucggggagaaguggaagaagaagcugaaccagcugagccgcaaggacuucgaccucuacaagaaguccggcaucaccgagguggaccggacggaggcgaaggaggggcugaagcgcggcgagaucacccaccacgccgucagccggggcuccgccaagcugcagugguucguggagcgcaacauggugaucccggaggggcgggucaucgaccucggcugcgggcgcggcggguggagcuacuacugcgccggccugaagaaggugaccgaggugcggggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccgcaccauccgcgugcugaagaugguggagccguggcucaagaacaaccaguucugcaucaagguccugaaccccuacaugcccacggugaucgagcaccuggagcggcuccagcgcaagcacggcgggaugcuggugcggaacccccugucccgcaacagcacccacgagauguacuggaucuccaacggcaccgggaacaucgucgccagcgugaacauggugucccggcuccugcugaaccgcuucaccaugacgcaccggcgcccgaccaucgagaaggacgucgaccucggcgcgggcacccggcacgugaacgccgagcccgagacccccaacauggacgugaucggggagcgcaucaagcggaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcgcguguucaaggagaagguggacacgcggaccccgcgcagcaugcccggcacccggcgcgucaugggcaucaccgccgaguggcucuggcggacgcuggggcgcaacaagaagccccggcugugcacccgcgaggaguucaccaagaaggugcgcaccaacgccgccaugggcgcgguguucacggaggagaaccagugggacuccgccaaggccgccgucgaggacgaggacuucuggaagcucguggaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaagguggugaagguccagcgccccacccccaccggcaccgugauggacaucaucagccggaaggaccagcgcggcuccggccaggugggcacguacgggcugaacaccuucaccaacauggaggcccagcucauccggcagauggagggcgaggggguccugagcaaggccgaccuggagaacccccaccucccggagaagaagaucacccaguggcuggagacgaagggcguggagcgccugaagcggauggcgaucuccggcgacgacugcguggucaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcccggaucagccagggggcgggcuggucccucaaggagaccgccugccugggcaaggccuacgcccagauguggagccugauguacuuccaccgccgcgaccuccggcuggcguccaacgccaucugcagcgccgugcccguccacugggugccgaccucccgcaccacguggagcauccacgcccaccaccaguggaugaccaccgaggacaugcugaccguguggaaccgggucuggaucgaggacaaccccuggauggaggacaagacgcccgugaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10029 - RNA, 9873 nt, Artificial Sequence
  derived and/or modified CDS sequence (opt1) from DENV-3__HM756279__SS-prME
accagccucugccucaugaugauccugcccgccgcccuggcguuccaccucaccagccgggacggggagccgcggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaccgucaucggcaucggggacaacgcccugaagaucaacugguacaagaagggcuccagcaucgggaagauguucgaggcgacggcccggggcgcccgccggauggccauccugggcgacaccgccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacacguccaugagcuucuccugcaucgccaucgggaucaucacccucuaccugggcgccguggugcaggccgacauggggugcgucaucaacuggaagggcaaggagcugaagugcggcagcgggaucuucgugaccaacgaggugcacaccuggacggagcaguacaaguuccaggcggacucccccaagcgccucgccaccgccaucgccggcgccugggagaacggggucugcggcauccgcagcaccacccggauggagaaccugcuguggaagcagaucgcgaacgagcucaacuacauccugugggagaacaacaucaagcugacggugguggucggggacaucaucggcgugcucgagcagggcaagcgcacccugacgccccagccgauggagcugaaguacuccuggaagaccugggggaaggccaagaucgugacggccgagacccagaacagcuccuucaucaucgacggccccaacacccccgagugccccagcgucucccgggccuggaacgugugggagguggaggacuacggguucggcgucuucaccaccaacaucuggcucaagcugcgcgagguguacacgcagcugugcgaccaccggcucaugagcgcggccgugaaggacgagcgcgccguccacgccgacaugggcuacuggaucgagagccagaagaacggguccuggaagcuggagaaggccagccugaucgaggugaagaccugcaccuggccgaagucccacacccucuggagcaacggcgugcuggaguccgacaugaucauccccaagagccuggcggggcccaucucccagcacaaccaccggccgggcuaccacacgcagaccgccgggcccuggcaccucggcaagcuggagcuggacuucaacuacugcgagggcaccaccgucgugaucacggagaacugcgggacccgcggccccagccuccggaccaccacgguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucacguggcgcgacauggcgcacacccugaucaugaucggcagcaacgccuccgaccggauggggaugggcgugaccuaccucgcccugaucgccaccuucaagauccagcccuuccuggcccucggguucuuccugcgcaagcugacgagccgggagaaccuccugcugggcgugggccucgcgauggccaccacccugcagcugcccgaggacaucgagcagauggccaacgggaucgcccucggccugauggcgcugaagcucaucacccaguucgagacguaccagcuguggaccgcccugaucagccugaccugcuccaacaccaucuucacgcugaccgucgccuggcgcaccgccacccugauccucgccggggugagccugcugccggucugccaguccagcuccaugcggaagacggacuggcuccccauggcgguggccgccaugggcgugccgccccucccgcuguucaucuucgggcucaaggacacccugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugacggucgagaaggccgcggacaucaccugggaggaggaggccgagcagaccggggugucccacaaccugaugaucaccguggacgacgacggcaccaugcgcaucaaggacgacgagacggagaacauccucaccguccugcugaagaccgcccuccugaucgugagcggcaucuucccguacuccauccccgccacccugcucguguggcacacguggcagaagcagacccagcggagcgggguccugugggacgugcccagcccgcccgagacccagaaggccgagcuggaggagggcguguaccgcaucaagcagcaggggaacuucugggagacccaggucggcgugggggugcagaaggagggcgucuuccacacgauguggcacgugacccggggcgcggugcucaccuacaacgggaagcgccuggagcccaacugggccagcgucaagaaggaccugaucuccuacggcgggggcuggcggcucagcgcccaguggcagaagggggaggagguccaggugaucgccgucgagcccggcaagaaccccaagaacuuccagaccaugcccggcacguuccagaccaccaccggggagaucggcgcgaucgcccuggacuucaagcccgggacguccggcagccccaucaucaaccgcgagggcaaggugguggggcuguacggcaacggggucgugaccaagaacggcggguacgugagcggcaucgcccagaccaacgccgagccggacggccccacccccgagcuggaggaggagauguucaagaagcggaaccucacgaucauggaccugcaccccggguccggcaagacccgcaaguaccugccggccaucguccgggaggcgaucaagcgccggcuccgcacccugauccuggcccccacccgggugguggccgccgagauggaggaggcccucaaggggcugcccauccgcuaccagacgaccgcgaccaagagcgagcacaccggccgggagaucgucgaccugaugugccacgccacguucaccaugcgccuccugucccccgugcgggugccgaacuacaaccugaucaucauggacgaggcccacuucaccgaccccgccagcaucgccgcgcgcggguacaucuccacccgggucggcaugggcgaggccgccgccaucuucaugacggcgacgccgcccgggaccgccgacgccuucccgcagagcaacgcccccauccaggacgaggagcgcgacauccccgagcgcuccuggaacagcggcaacgaguggaucaccgacuucgccgggaagacggugugguucgugcccuccaucaaggcgggcaacgacaucgccaacugccuccggaagaacgggaagaaggucauccagcugagccgcaagaccuucgacaccgaguaccagaagaccaagcugaacgacugggacuucguggugacgaccgacaucuccgagaugggcgccaacuucaaggccgaccgggucaucgacccgcgccggugccucaagcccgugauccugaccgacggccccgagcgcgugauccuggccgggcccaugccggucaccgcggccagcgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagagccggaagaccuucguggagcugaugcgccgcggggaccucaccgucuggcuggcgcacaagguggccuccgagggcaucaaguacacggaccgcaaguggugcuucgacgggcagcggaacaaccagauccuggaggagaacauggacgucgagaucuggaccaaggagggcgagaagaagaagcuccgcccccgguggcuggacgcccgcaccuacagcgacccccuggcccucaaggaguucaaggaguucgccgcgggccgcaaguccaucgcccuggaccuggugaccgagaucgggcgggugccgagccaccucgcccaccgcacgcggaacgcccuggacaaccuggucaugcuccacaccuccgagcacggcgggcgcgccuaccggcacgcgguggaggagcugcccgagaccauggagacccugcuccugcugggccucaugauccugcugaccggcggggccaugcuguuccugaucagcgggaaggggaucggcaagaccagcaucgggcugaucugcgugaucgccuccagcggcaugcucuggauggccgagaucccccugcaguggaucgccuccgcgaucguccuggaguucuucaugauggugcuccugaucccggagcccgagaagcagcgcacgccccaggacaaccagcuggccuacguggucaucgggauccucacccuggccgccaucaucgccgcgaacgagaugggccugcucgagacgaccaagcgggaccugggcaugagcaaggagcccggggugguguccccgaccagcuaccuggacgucgaccuccaccccgccuccgccuggacccuguacgccguggcgacgaccgugaucacccccaugcugcgccacaccaucgagaacagcacggccaacgucucccucgccgccaucgccaaccaggcgguggugcugaugggccuggacaagggguggcccaucagcaagauggaccucggcgucccgcugcuggcccucgggugcuacucccaggugaacccccugacccugaccgccgccgugcuccugcugaucacccacuacgccaucaucggccccggccuccaggcgaaggccacgcgggaggcccagaagcgcaccgccgccgggaucaugaagaaccccaccgucgacggcaucaugaccaucgaccuggacccggugaucuacgacagcaaguucgagaagcagcugggccaggugaugcuccugguccugugcgcggugcagcuccugcugaugcggacguccugggcccucugcgaggcccugacccuggccaccggccccaucaccacgcucugggagggcagccccgggaaguucuggaacaccaccaucgcgguguccauggccaacaucuuccgcggcagcuaccuggccggggccggccuggccuucuccaucaugaaguccgucgggaccggcaagcggggcaccgggucccagggcgagacgcucggggagaaguggaagaagaagcugaaccagcugagccgcaaggacuucgaccucuacaagaaguccggcaucaccgagguggaccggaccgaggcgaaggaggggcugaagcgcggcgagaucacccaccacgccgugucccggggcagcgccaagcugcagugguucgucgagcgcaacauggugauccccgaggggcgggugaucgaccucggcugcgggcgcggcgggugguccuacuacugcgccggccugaagaaggucacggaggugcggggcuacaccaagggcgggccggggcacgaggagcccgugcccaugagcaccuacggcuggaacaucgucaagcugauguccgggaaggacguguucuaccucccgcccgagaagugcgacacccugcugugcgacaucggcgagagcucccccagccccacgguggaggagucccgcaccauccgcguccugaagaugguggagcccuggcucaagaacaaccaguucugcaucaaggugcugaaccccuacaugcccaccgucaucgagcaccuggagcggcuccagcgcaagcacggcgggaugcuggugcggaacccccugagccgcaacuccacccacgagauguacuggaucagcaacggcacggggaacaucguggccuccgucaacauggugagccggcuccugcugaaccgcuucaccaugacccaccggcgccccaccaucgagaaggacguggaccucggcgcgggcacgcggcacgucaacgccgagccggagacccccaacauggacgugaucggggagcgcaucaagcggaucaaggaggagcacaacuccaccuggcacuacgacgacgagaaccccuacaagaccugggccuaccacggcagcuacgaggugaaggccacgggguccgccagcuccaugaucaacggcgucgugaagcugcugaccaagccgugggacgucgugcccauggugacccagauggcgaugaccgacacgacccccuucgggcagcagcgcgucuucaaggagaagguggacacccggacgccccggagcaugccgggcacgcggcgcgugaugggcaucaccgccgaguggcucuggcggacccuggggcgcaacaagaagccccggcugugcacccgcgaggaguucacgaagaagguccgcaccaacgccgccaugggcgcgguguucaccgaggagaaccagugggacagcgccaaggccgccguggaggacgaggacuucuggaagcucgucgaccgggagcgcgagcugcacaagcuggggaagugcggcuccugcguguacaacaugauggggaagcgggagaagaagcucggcgaguucggcaaggccaaggggagccgcgcgaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgccauguacgccgacgacaccgcggggugggacacgcgcaucaccgaggacgaccugcacaacgaggagaagaucacccagcagauggaccccgagcaccggcagcucgccaacgccaucuucaagcugaccuaccagaacaaggucgugaaggugcagcgcccgacccccacgggcaccgucauggacaucaucucccggaaggaccagcgcggcagcggccaggugggcaccuacgggcugaacaccuucacgaacauggaggcccagcucauccggcagauggagggcgagggggugcuguccaaggccgaccuggagaacccccaccuccccgagaagaagaucacccaguggcuggagaccaagggcgucgagcgccugaagcggauggcgaucagcggcgacgacugcguggugaagccgaucgacgaccgcuucgccaacgcccuccuggcccugaacgacauggggaagguccggaaggacaucccccaguggcagcccuccaagggcuggcacgacuggcagcagguccccuucugcagccaccacuuccacgagcucaucaugaaggacgggcgcaagcugguggucccgugccggccccaggacgagcugaucggccgcgcccggaucucccagggggcgggcuggagccucaaggagaccgccugccugggcaaggccuacgcccagauguggucccugauguacuuccaccgccgcgaccuccggcuggcgagcaacgccaucugcuccgccgugcccgugcacuggguccccacgagccgcaccaccugguccauccacgcccaccaccaguggaugaccacggaggacaugcugaccguguggaaccggguguggaucgaggacaacccguggauggaggacaagacccccgucaccacgugggagaacgugcccuaccucgggaagcgcgaggaccaguggugcggcagccugaucgggcugaccagccgggccaccugggcgcagaacauccccaccgccauccagcagguccgcucccucaucggcaacgaggaguuccuggacuacaugccgagcaugaagcgguuccgcaaggaggaggaguccgagggggccaucugguga

SEQ ID NO: 10030 - RNA, 9873 nt, Artificial Sequence
  derived and/or modified CDS sequence (opt1) from DENV-3__HQ891025__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucgggcucaaggacacgcugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugaccgucgagaaggccgcggacaucacgugggaggaggaggccgagcagaccggggugucccacaaccugaugaucaccguggacgacgacggcaccaugcgcaucaaggacgacgagaccgagaacauccucacgguccugcugaagaccgcccuccugaucgugagcggcaucuucccguacuccauccccgccacccugcucguguggcacaccuggcagaagcagacgcagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacaccauguggcacgugacgcgcggggcggugcucaccuacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggaccuuccagacgaccaccggcgagaucggggcgaucgcccuggacuucaagcccggcaccuccggcagccccaucaucaaccgcgaggggaagguggugggccuguacgggaacggcgucgugacgaagaacgggggcuacgugagcggcaucgcccagaccaacgccgagccggacgggcccacccccgagcuggaggaggagauguucaagaagcggaaccucaccaucauggaccugcaccccggcuccgggaagacgcgcaaguaccugccggccaucguccgggaggcgaucaagcgccggcuccgcacccugauccuggcccccacccgggugguggccgccgagauggaggaggcccucaagggccugcccauccgcuaccagaccacggcgaccaagagcgagcacaccgggcgggagaucgucgaccugaugugccacgccaccuucacgaugcgccuccugucccccgugcgggugccgaacuacaaccugaucaucauggacgaggcccacuucaccgaccccgccagcaucgccgcgcgcggcuacaucuccacccgggucggcaugggggaggccgccgccaucuucaugaccgcgacgccgcccggcaccgccgacgccuucccgcagagcaacgcccccauccaggacgaggagcgcgacauccccgagcgcuccuggaacagcgggaacgaguggaucaccgacuucgccggcaagaccgugugguucgugcccuccaucaaggcggggaacgacaucgccaacugccuccggaagaacggcaagaaggucauccagcugagccgcaagacguucgacaccgaguaccagaagaccaagcugaacgacugggacuucguggugaccacggacaucuccgagaugggcgccaacuucaaggccgaccgggucaucgacccgcgccggugccucaagcccgugauccugaccgacgggcccgagcgcgugauccuggccggccccaugccggucaccgcggccagcgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacgcccgagggcaucaucccggcccucuucgagcccgagcgggagaaguccgccgccaucgacggcgaguaccgccugaagggggagagccggaagaccuucguggagcugaugcgccggggcgaccuccccgucuggcuggcgcacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcacguacagcgacccgcuggcccucaaggaguucaaggaguucgccgcggggcgcaaguccaucgcccuggaccuggugaccgagaucggccgggugcccagccaccucgcccaccgcacccggaacgcccuggacaaccuggucaugcuccacaccuccgagcacgggggccgcgccuaccggcacgcgguggaggagcugcccgagacgauggagacccugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgccuccgcgaucguccuggaguucuucaugauggugcuccugauccccgagcccgagaagcagcgcacgccccaggacaaccagcuggccuacguggucaucggcauccucacccuggccgccaucaucgccgcgaacgagaugggccugcucgagaccaccaagcgggaccuggggaugagcaaggagccgggcguggugucccccacgagcuaccuggacgucgaccuccaccccgccuccgccuggacccuguacgccguggcgaccaccgugaucacgcccaugcugcgccacaccaucgagaacagcaccgccaacgucucccucgccgccaucgccaaccaggcgguggugcugauggggcuggacaagggcuggccgaucagcaagauggaccucggggucccccugcuggcccucggcugcuacucccaggugaacccccugacccugacggccgccgugcuccugcugaucacccacuacgccaucaucggccccgggcuccaggcgaaggccacccgggaggcccagaagcgcaccgccgccggcaucaugaagaacccgacggucgacgggaucaugaccaucgaccuggaccccgugaucuacgacagcaaguucgagaagcagcugggccaggugaugcuccugguccugugcgcggugcagcuccugcugaugcggaccuccugggcccucugcgaggcccugacccuggccacgggccccaucaccacccucugggaggggagccccggcaaguucuggaacaccacgaucgcgguguccauggccaacaucuuccgcgggagcuaccuggccggcgccgggcuggccuucuccaucaugaaguccgucggcaccggcaagcgggggaccggcucccagggggagacccucggcgagaaguggaagaagaagcugaaccagcugagccgcaaggacuucgaccucuacaagaaguccgggaucaccgagguggaccggacggaggcgaaggagggccugaagcgcggcgagaucacccaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacaccaagggcgggcccggccacgaggagcccgugcccaugagcacguacggguggaacaucgucaagcugauguccggcaaggacguguucuaccucccgcccgagaagugcgacacccugcugugcgacaucggcgagagcucccccagccccaccguggaggagucccgcaccauccgcguccugaagaugguggagccguggcucaagaacaaccaguucugcaucaaggugcugaaccccuacaugcccacggucaucgagcaccuggagcggcuccagcgcaagcacgggggcaugcuggugcggaacccccugagccgcaacuccacccacgagauguacuggaucagcaacgggaccggcaacaucguggccuccgucaacauggugagccggcuccugcugaaccgcuucaccaugacgcaccggcgcccgaccaucgagaaggacguggaccucggcgcggggacccggcacgucaacgccgagcccgagacccccaacauggacgugaucggcgagcgcaucaagcggaucaaggaggagcacaacuccacguggcacuacgacgacgagaacccguacaagaccugggccuaccacgggagcuacgaggugaaggccaccggcuccgccagcuccaugaucaacggggucgugaagcugcugaccaagcccugggacgucgugcccauggugacgcagauggcgaugaccgacaccacccccuucggccagcagcgcgucuucaaggagaagguggacacgcggaccccgcgcagcaugcccggcacccggcgcgugauggggaucaccgccgaguggcucuggcggacgcugggccgcaacaagaagccccggcugugcacccgcgaggaguucaccaagaagguccgcaccaacgccgccaugggggcgguguucacggaggagaaccagugggacagcgccaaggccgccguggaggacgaggacuucuggaagcucgucgaccgggagcgcgagcugcacaagcugggcaagugcggguccugcguguacaacaugaugggcaagcgggagaagaagcucggcgaguucgggaaggccaagggcagccgcgcgaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgccgacgacaccgcgggcugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucucccggaaggaccagcgcgggagcggccagguggggacguacggccugaacaccuucaccaacauggaggcccagcucauccggcagauggagggggagggcgugcuguccaaggccgaccuggagaacccccaccucccggagaagaagaucacccaguggcuggagacgaagggcgucgagcgccugaagcggauggcgaucagcggggacgacugcguggugaagcccaucgacgaccgcuucgccaacgcccuccuggcccugaacgacaugggcaagguccggaaggacaucccccaguggcagcccuccaagggguggcacgacuggcagcaggucccguucugcagccaccacuuccacgagcucaucaugaaggacggccgcaagcuggugguccccugccggccccaggacgagcugaucgggcgcgcccggaucucccagggcgcgggcuggagccucaaggagaccgccugccuggggaaggccuacgcccagauguggucccugaugaacuuccaccgccgcgaccuccggcuggcgagcaacgccaucugcuccgccgugcccgugcacugggucccgaccagccgcaccacgugguccauccacgcccaccaccaguggaugaccaccgaggacaugcugaccguguggaaccggguguggaucgaggacaaccccuggauggaggacaagacgcccgucaccaccugggagaacgugcccuaccucggcaagcgcgaggaccaguggugcgggagccugaucggccugaccagccgggccacgugggcgcagaacaucccgaccgccauccagcagguccgcucccucaucgggaacgaggaguuccuggacuacaugcccagcaugaagcgguuccgcaaggaggaggaguccgagggcgccaucugguga

SEQ ID NO: 10031 - RNA, 9873 nt, Artificial Sequence
  derived and/or modified CDS sequence (opt1) from DENV-3__HQ705617__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuuccgcauccagcccuuccuggcccucggguucuuccugcggaagcugaccagccgcgagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcggaccgccacccugauccucgccggggugagccugcugccggucugccaguccagcuccaugcgcaagaccgacuggcuccccauggcgguggccgccaugggcgugccgccccucccgcuguucaucuucgggcucaaggacacgcugaagcgccggagcuggccccugaacgagggcgucauggccgugggccucguguccauccuggccagcucccugcuccgcaacgacguccccauggcggggccccugguggccggcgggcugcucaucgccugcuacgugaucaccggcaccagcgccgaccugaccgucgagaaggccgcggacaucacgugggaggaggaggccgagcagaccggggugucccacaaccugaugaucaccguggacgacgacggcaccaugcggaucaaggacgacgagaccgagaacauccucacgguccugcugaagaccgcccuccugaucgugagcggcaucuucccguacuccauccccgccacccugcucguguggcacaccuggcagaagcagacgcagcgcagcgggguccugugggacgugcccagcccgcccgagacccagaaggccgagcuggaggagggcguguaccggaucaagcagcaggggaucuucggcaagacccaggucggggugggcgugcagaaggagggcgucuuccacaccauguggcacgugacgcgcggggcggugcucaccuacaacggcaagcggcuggagcccaacugggccagcgucaagaaggaccugaucuccuacgggggcggguggcgccucagcgcccaguggcagaagggcgaggagguccaggugaucgccgucgagcccggcaagaaccccaagaacuuccagaccaugcccgggaccuuccagacgaccaccggcgagaucggggcgaucgcccuggacuucaagcccggcaccuccggcagccccaucaucaaccgggaggggaagguggugggccuguacgggaacggcgucgugacgaagaacgggggcuacgugagcggcaucgcccagaccaacgccgagccggacgggcccacccccgagcuggaggaggagauguucaagaagcgcaaccucaccaucauggaccugcaccccggcuccgggaagacgcggaaguaccugccggccaucguccgcgaggcgaucaagcggcgccuccggacccugauccuggcccccacccgcgugguggccgccgagauggaggaggcccucaagggccugcccauccgguaccagaccacggcgaccaagagcgagcacaccgggcgcgagaucgucgaccugaugugccacgccaccuucacgaugcggcuccugucccccgugcgcgugccgaacuacaaccugaucaucauggacgaggcccacuucaccgaccccgccagcaucgccgcgcggggcuacaucuccacccgcgucggcaugggggaggccgccgccaucuucaugaccgcgacgccgcccggcaccgccgacgccuucccgcagagcaacgcccccauccaggacgaggagcgcgacauccccgagcgguccuggaacagcgggaacgaguggaucaccgacuucgccggcaagaccgugugguucgugcccuccaucaaggcggggaacgacaucgccaacugccuccgcaagaacggcaagaaggucauccagcugagccggaagacguucgacaccgaguaccagaagaccaagcugaacgacugggacuucguggugaccacggacaucuccgagaugggcgccaacuucaaggccgaccgcgucaucgacccgcggcgcugccucaagcccgugauccugaccgacgggcccgagcgggugauccuggccggccccaugccggucaccgcggccagcgccgcccagcgccgggggcgcgugggccggaacccccagaaggagaacgaccaguacaucuucaccgggcagccccucaacaacgacgaggaccacgcccacuggaccgaggcgaagaugcugcuggacaacaucaacacgcccgagggcaucaucccggcccucuucgagcccgagcgcgagaaguccgccgccaucgacggcgaguaccggcugaagggggagagccgcaagaccuucguggagcugaugcggcgcggcgaccuccccgucuggcuggcgcacaagguggccuccgaggggaucaaguacaccgaccggaaguggugcuucgacggccagcgcaacaaccagauccuggaggagaacauggacgucgagaucuggaccaaggagggcgagaagaagaagcuccggccccgcuggcuggacgcccgcacguacagcgacccgcuggcccucaaggaguucaaggaguucgccgcggggcggaaguccaucgcccuggaccuggugaccgagaucggccgcgugcccagccaccucgcccaccggacccgcaacgcccuggacaaccuggucaugcuccacaccuccgagcacgggggccgggccuaccgccacgcgguggaggagcugcccgagacgauggagacccugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgccuccgcgaucguccuggaguucuucaugauggugcuccugauccccgagcccgagaagcagcggacgccccaggacaaccagcuggccuacguggucaucggcauccucacccuggccgccaucaucgccgcgaacgagaugggccugcucgagaccaccaagcgcgaccuggggaugagcaaggagccgggcguggugucccccacgagcuaccuggacgucgaccuccaccccgccuccgccuggacccuguacgccguggcgaccaccgugaucacgcccaugcugcggcacaccaucgagaacagcaccgccaacgucucccucgccgccaucgccaaccaggcgguggugcugauggggcuggacaagggcuggccgaucagcaagauggaccucggggucccccugcuggcccucggcugcuacucccaggugaacccccugacccugacggccgccgugcuccugcugaucacccacuacgccaucaucggccccgggcuccaggcgaaggccacccgcgaggcccagaagcggaccgccgccggcaucaugaagaacccgacggucgacgggaucaugaccaucgaccuggaccccgugaucuacgacagcaaguucgagaagcagcugggccaggugaugcuccugguccugugcgcggugcagcuccugcugaugcgcaccuccugggcccucugcgaggcccugacccuggccacgggccccaucaccacccucugggaggggagccccggcaaguucuggaacaccacgaucgcgguguccauggccaacaucuuccgggggagcuaccuggccggcgccgggcuggccuucuccaucaugaaguccgucggcaccggcaagcgcgggaccggcucccagggggagacccucggcgagaaguggaagaagaagcugaaccagcugagccggaaggacuucgaccucuacaagaaguccgggaucaccgagguggaccgcacggaggcgaaggagggccugaagcggggcgagaucacccaccacgccgugucccgcgggagcgccaagcugcagugguucgucgagcggaacauggugaucccggagggccgcgugaucgaccucgggugcggccgcgggggcugguccuacuacugcgccggccugaagaaggucaccgaggugcgcggguacaccaagggcgggcccggccacgaggagcccgugcccaugagcacguacggguggaacaucgucaagcugauguccggcaaggacguguucuaccucccgcccgagaagugcgacacccugcugugcgacaucggcgagagcucccccagccccaccguggaggagucccgcaccauccggguccugaagaugguggagccguggcucaagaacaaccaguucugcaucaaggugcugaaccccuacaugcccacggucaucgagcaccuggagcgccuccagcggaagcacgggggcaugcuggugcgcaacccccugagccggaacuccacccacgagauguacuggaucagcaacgggaccggcaacaucguggccuccgucaacauggugagccgccuccugcugaaccgguucaccaugacgcaccgccggccgaccaucgagaaggacguggaccucggcgcggggacccgccacgucaacgccgagcccgagacccccaacauggacgugaucggcgagcggaucaagcgcaucaaggaggagcacaacuccacguggcacuacgacgacgagaacccguacaagaccugggccuaccacgggagcuacgaggugaaggccaccggcuccgccagcuccaugaucaacggggucgugaagcugcugaccaagcccugggacgucgugcccauggugacgcagauggcgaugaccgacaccacccccuucggccagcagcgggucuucaaggagaagguggacacgcgcaccccgcggagcaugcccggcacccgccgggugauggggaucaccgccgaguggcucuggcgcacgcugggccggaacaagaagccccgccugugcacccgcgaggaguucaccaagaagguccggaccaacgccgccaugggggcgguguucacggaggagaaccagugggacagcgccaaggccgccguggaggacgaggacuucuggaagcucgucgaccgcgagcgggagcugcacaagcugggcaagugcggguccugcguguacaacaugaugggcaagcgcgagaagaagcucggcgaguucgggaaggccaagggcagccgggcgaucugguacauguggcugggggcccgcuaccuggaguucgaggcccucggcuuccugaacgaggaccacugguucucccgggagaacagcuacuccgggguggagggcgagggccugcacaagcucggguacauccugcgcgacaucagcaagauccccggcggggccauguacgccgacgacaccgcgggcugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaccggcaccgucauggacaucaucucccgcaaggaccagcgggggagcggccagguggggacguacggccugaacaccuucaccaacauggaggcccagcucauccgccagauggagggggagggcgugcuguccaaggccgaccuggagaacccccaccucccggagaagaagaucacccaguggcuggagacgaagggcgucgagcggcugaagcgcauggcgaucagcggggacgacugcguggugaagcccaucgacgaccgguucgccaacgcccuccuggcccugaacgacaugggcaagguccgcaaggacaucccccaguggcagcccuccaagggguggcacgacuggcagcaggucccguucugcagccaccacuuccacgagcucaucaugaaggacggccggaagcuggugguccccugccgcccccaggacgagcugaucgggcgggcccgcaucucccagggcgcgggcuggagccucaaggagaccgccugccuggggaaggccuacgcccagauguggucccugauguacuuccaccgccgggaccuccgccuggcgagcaacgccaucugcuccgccgugcccgugcacugggucccgaccagccggaccacgugguccauccacgcccaccaccaguggaugaccaccgaggacaugcugaccguguggaaccgcguguggaucgaggacaaccccuggauggaggacaagacgcccgucaccaccugggagaacgugcccuaccucggcaagcgggaggaccaguggugcgggagccugaucggccugaccagccgcgccacgugggcgcagaacaucccgaccgccauccagcagguccggucccucaucgggaacgaggaguuccuggacuacaugcccagcaugaagcgcuuccggaaggaggaggaguccgagggcgccaucugguga

SEQ ID NO: 10032 - RNA, 9873 nt, Artificial Sequence
  derived and/or modified CDS sequence (opt1) from DENV-3__HQ705619__SS-prME
accagccugugccugaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugcccgaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccucaccuggaaccgcaaggagcugcuggugaccuucaagaacgcccacgccaagaagcaggagguggucgugcucgggucccaggagggcgcgaugcacacggcccugaccggggccaccgagauccagaacagcggcgggaccuccaucuucgccggccaccugaagugccggcucaagauggacaagcuggagcugaagggcaugagcuacgccaugugcacgaacaccuucgugcucaagaaggaggucuccgagacccagcacgggaccauccugaucaagguggaguacaagggcgaggacgugcccugcaagaucccguucagcacggaggacgggcagggcaaggcgcacaacggccgccugaucaccgccaaccccgucgugaccaagaaggaggagcccgugaacaucgaggccgagcccccguucggggagagcaacaucgucaucggcaucggggacaacgcccugaagaucaacugguacaagaagggcuccagcaucgggaagauguucgaggcgaccgcccggggcgcccgccggauggccauccucggcgacacggccugggacuucggguccgugggcggggugcugaacagccugggcaagaugguccaccagaucuucggguccgcguacaccgcccucuucagcggcguguccugggugaugaagaucggcaucgggguccugcugaccuggaucggccucaacagcaagaacaccuccaugagcuucuccugcaucgccaucgggaucaucacgcuguaccugggcgccguggugcaggccgacauggggugcgucaucaacuggaagggcaaggagcucaagugcggcagcgggaucuucgugaccaacgaggugcacaccuggaccgagcaguacaaguuccaggcggacucccccaagcgccuggccacggccaucgccggcgccugggagaacggggucugcggcauccgcagcaccacccggauggagaaccugcucuggaagcagaucgcgaacgagcugaacuacauccugugggagaacaacaucaagcucaccgugguggucggggacaucaucggcgugcuggagcagggcaagcgcacgcugacgccccagcccauggagcucaaguacuccuggaagaccugggggaaggccaagaucgugaccgccgagacgcagaacagcuccuucaucaucgacggcccgaacacccccgagugccccagcgucucccgggccuggaacgugugggagguggaggacuacggguucggcgucuucaccaccaacaucuggcugaagcugcgcgagguguacacccagcucugcgaccaccggcugaugagcgcggccgugaaggacgagcgcgccguccacgccgacaugggcuacuggaucgagagccagaagaacggguccuggaagcuggagaaggccagccucaucgaggugaagacgugcaccuggcccaagucccacacccuguggagcaacggcgugcuggaguccgacaugaucauccccaagagccucgcggggcccaucucccagcacaaccaccggcccggcuaccacacccagacggccgggccguggcaccugggcaagcuggagcucgacuucaacuacugcgagggcaccaccgucgugaucaccgagaacugcgggacgcgcggccccagccugcggaccaccaccguguccgggaagcugauccacgaguggugcugccgcagcugcacgcugccgccccuccgguacaugggcgaggacgggugcugguacggcauggagauccgcccgaucuccgagaaggaggagaacauggucaagagccugguguccgccggcagcgggaagguggacaacuucaccaugggcguccucugccuggccauccuguucgaggaggugaugcgggggaaguucggcaagaagcacaugaucgccgggguguucuucaccuucguccuccugcuguccggccagaucaccuggcgcgacauggcgcacacgcucaucaugaucggcagcaacgccuccgaccggauggggaugggcgugaccuaccuggcccugaucgccaccuucaagauccagcccuuccucgcccugggguucuuccugcgcaagcucaccagccgggagaaccugcugcucggcgugggccuggcgauggccacgacccugcagcuccccgaggacaucgagcagauggccaacgggaucgcccugggccugauggcgcucaagcugaucacccaguucgagaccuaccagcuguggacggcccucaucagccugaccugcuccaacaccaucuucacccugacggucgccuggcgcaccgccacccucauccuggccggggugagccugcuccccgucugccaguccagcuccaugcggaagaccgacuggcugccgauggcgguggccgccaugggcgugccgccccugccccucuucaucuucgggcugaaggacacgcugaagcgccgcagcuggccgcucaacgagggcgucauggccgugggccugguguccauccuggccagcucccuccugcggaacgacguccccauggcggggccccugguggccggcgggcuccugaucgccugcuacgugaucaccggcaccagcgccgaccugaccgucgagaaggccgcggacaucacgugggaggaggaggccgagcagaccggggugucccacaaccucaugaucaccguggacgacgacggcaccaugcgcaucaaggacgacgagaccgagaacauccugacgguccugcucaagaccgcccugcugaucgugagcggcaucuuccccuacuccaucccggccacccuccugguguggcacaccuggcagaagcagacgcagcggagcgggguccugugggacgugcccagcccgcccgagacccagaaggccgagcucgaggagggcguguaccgcaucaagcagcaggggaucuucggcaagacccaggucggggugggcgugcagaaggagggcgucuuccacaccauguggcacgugacgcgcggggcggugcugaccuacaacggcaagcgccuggagccgaacugggccagcgucaagaaggaccucaucuccuacgggggcggguggcggcugagcgcccaguggcagaagggcgaggagguccaggugaucgccgucgagcccggcaagaaccccaagaacuuccagaccaugcccgggaccuuccagacgaccaccggcgagaucggggcgaucgcccuggacuucaagccgggcaccuccggcagccccaucaucaaccgcgaggggaagguggugggccuguacgggaacggcgucgugacgaagaacgggggcuacgugagcggcaucgcccagaccaacgccgagcccgacgggccgacccccgagcucgaggaggagauguucaagaagcggaaccugaccaucauggaccugcaccccggcuccgggaagacgcgcaaguaccuccccgccaucguccgggaggcgaucaagcgccggcugcgcacccugauccucgccccgacccgggugguggccgccgagauggaggaggcccugaagggccugcccauccgcuaccagaccacggcgaccaagagcgagcacaccgggcgggagaucgucgaccucaugugccacgccaccuucacgaugcgccugcugucccccgugcgggugcccaacuacaaccucaucaucauggacgaggcccacuucaccgacccggccagcaucgccgcgcgcggcuacaucuccacccgggucggcaugggggaggccgccgccaucuucaugaccgcgacgccgcccggcaccgccgacgccuucccccagagcaacgccccgauccaggacgaggagcgcgacauccccgagcgcuccuggaacagcgggaacgaguggaucaccgacuucgccggcaagaccgugugguucgugcccuccaucaaggcggggaacgacaucgccaacugccugcggaagaacggcaagaaggucauccagcugagccgcaagacguucgacaccgaguaccagaagaccaagcucaacgacugggacuucguggugaccacggacaucuccgagaugggcgccaacuucaaggccgaccgggucaucgacccccgccggugccugaagccggugauccugaccgacgggcccgagcgcgugauccucgccggccccaugcccgucaccgcggccagcgccgcccagcggcgcgggcgggugggccgcaacccgcagaaggagaacgaccaguacaucuucaccgggcagccccugaacaacgacgaggaccacgcccacuggaccgaggcgaagaugcugcucgacaacaucaacacgcccgagggcaucauccccgcccuguucgagccggagcgggagaaguccgccgccaucgacggcgaguaccgccugaagggggagagccggaagaccuucguggagcucaugcgccggggcgaccugcccgucuggcuggcgcacaagguggccuccgaggggaucaaguacaccgaccgcaaguggugcuucgacggccagcggaacaaccagauccucgaggagaacauggacgucgagaucuggaccaaggagggcgagaagaagaagcugcgcccccgguggcuggacgcccgcacguacagcgacccccucgcccugaaggaguucaaggaguucgccgcggggcgcaaguccaucgcccuggaccucgugaccgagaucggccgggugccgagccaccuggcccaccgcacccggaacgcccuggacaaccucgucaugcugcacaccuccgagcacgggggccgcgccuaccggcacgcgguggaggagcugcccgagacgauggagacccuccugcugcucgggcugaugauccugcucaccggcggcgccaugcuguuccugaucagcgggaagggcaucgggaagaccagcaucggccucaucugcgugaucgccuccagcgggaugcuguggauggccgagaucccccugcaguggaucgccuccgcgaucguccucgaguucuucaugauggugcugcugaucccggagcccgagaagcagcgcacgccccaggacaaccagcucgccuacguggucaucggcauccugacccuggccgccaucaucgccgcgaacgagaugggccuccuggagaccaccaagcgggaccuggggaugagcaaggagcccggcgugguguccccgacgagcuaccucgacgucgaccugcaccccgccuccgccuggacccuguacgccguggcgaccaccgugaucacgcccaugcuccgccacaccaucgagaacagcaccgccaacgucucccuggccgccaucgccaaccaggcgguggugcugauggggcucgacaagggcuggcccaucagcaagauggaccugggggucccgcugcucgcccugggcugcuacucccaggugaacccccugacccucacggccgccgugcugcugcucaucacccacuacgccaucaucggccccgggcugcaggcgaaggccacccgggaggcccagaagcgcaccgccgccggcaucaugaagaaccccacggucgacgggaucaugaccaucgaccuggacccggugaucuacgacagcaaguucgagaagcagcucggccaggugaugcugcugguccucugcgcggugcagcugcugcucaugcggaccuccugggcccugugcgaggcccugacccucgccacgggccccaucaccacccugugggaggggagccccggcaaguucuggaacaccacgaucgcgguguccauggccaacaucuuccgcgggagcuaccuggccggcgccgggcucgccuucuccaucaugaaguccgucggcaccggcaagcgggggaccggcucccagggggagacccugggcgagaaguggaagaagaagcugaaccagcucagccgcaaggacuucgaccuguacaagaaguccgggaucaccgagguggaccggacggaggcgaaggagggccugaagcgcggcgagaucacccaccacgccgugucccgggggagcgccaagcuccagugguucgucgagcgcaacauggugauccccgagggccgggugaucgaccuggggugcggccgcgggggcugguccuacuacugcgccggccugaagaaggucaccgaggugcggggguacaccaagggcgggccgggccacgaggagcccgugcccaugagcacguacggguggaacaucgucaagcucauguccggcaaggacguguucuaccugcccccggagaagugcgacacccugcugugcgacaucggcgagagcucccccagccccaccguggaggagucccgcaccauccgcguccucaagaugguggagcccuggcugaagaacaaccaguucugcaucaaggugcugaacccguacaugcccacggucaucgagcaccucgagcggcugcagcgcaagcacgggggcaugcuggugcggaacccccucagccgcaacuccacccacgagauguacuggaucagcaacgggaccggcaacaucguggccuccgucaacauggugagccggcugcugcucaaccgcuucaccaugacgcaccggcgccccaccaucgagaaggacguggaccugggcgcggggacccggcacgucaacgccgagccggagacccccaacauggacgugaucggcgagcgcaucaagcggaucaaggaggagcacaacuccacguggcacuacgacgacgagaaccccuacaagaccugggccuaccacgggagcuacgaggugaaggccaccggcuccgccagcuccaugaucaacggggucgugaagcugcucaccaagccgugggacgucgugcccauggugacgcagauggcgaugaccgacaccacccccuucggccagcagcgcgucuucaaggagaagguggacacgcggacgccccgcagcaugccgggcacccggcgcgugauggggaucaccgccgaguggcuguggcggacccugggccgcaacaagaagccccggcucugcacccgcgaggaguucaccaagaagguccgcaccaacgccgccaugggggcgguguucacggaggagaaccagugggacagcgccaaggccgccguggaggacgaggacuucuggaagcuggucgaccgggagcgcgagcugcacaagcucggcaagugcggguccugcguguacaacaugaugggcaagcgggagaagaagcugggcgaguucgggaaggccaagggcagccgcgcgaucugguacauguggcugggggcccgguaccucgaguucgaggcccugggcuuccugaacgaggaccacugguucucccgcgagaacagcuacuccgggguggagggcgagggccuccacaagcugggguacauccugcgggacaucagcaagauccccggcggggccauguacgccgacgacaccgcgggcugggacacccgcaucaccgaggacgaccuccacaacgaggagaagaucacgcagcagauggaccccgagcaccggcagcuggccaacgccaucuucaagcugaccuaccagaacaaggucgugaaggugcagcgcccgacccccaccggcaccgucauggacaucaucucccggaaggaccagcgcgggagcggccagguggggacguacggccucaacaccuucaccaacauggaggcccagcugauccggcagauggagggggagggcgugcuguccaaggccgaccucgagaacccccaccuccccgagaagaagaucacccaguggcuggagacgaagggcgucgagcgccucaagcggauggcgaucagcggggacgacugcguggugaagccgaucgacgaccgcuucgccaacgcccugcuggcccucaacgacaugggcaagguccggaaggacaucccccaguggcagcccuccaagggguggcacgacuggcagcagguccccuucugcagccaccacuuccacgagcugaucaugaaggacggccgcaagcugguggucccgugccggccccaggacgagcucaucgggcgcgcccggaucucccagggcgcgggcuggagccugaaggagaccgccugccuggggaaggccuacgcccagauguggucccucauguacuuccaccgccgcgaccugcggcuggcgagcaacgccaucugcuccgccgugcccgugcacuggguccccaccagccgcaccacgugguccauccacgcccaccaccaguggaugaccaccgaggacaugcucaccguguggaaccggguguggaucgaggacaacccguggauggaggacaagacgcccgucaccaccugggagaacgugcccuaccugggcaagcgcgaggaccaguggugcgggagccugaucggccucaccagccgggccacgugggcgcagaacauccccaccgccauccagcagguccgcucccugaucgggaacgaggaguuccuggacuacaugccgagcaugaagcgguuccgcaaggaggaggaguccgagggcgccaucugguga

SEQ ID NO: 10033 - RNA, 9873 nt, Artificial Sequence
  derived and/or modified CDS sequence (opt1) from DENV-3__HQ705620__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccugggugggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgugucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagacgugcaccuggccgaagucccacacccucuggagcaacggcguccuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccguggugaucaccgagaacugcgggacgcgcggccccagccuccggaccaccaccgucuccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaaggucgacaacuucaccaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgccggcugaccagccgcgagaaccuccugcugggcgucggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacgguggccuggcggaccgccacccugauccucgccggggucagccugcugccggugugccaguccagcuccaugcgcaagaccgacuggcuccccauggcgguggccgccaugggcgugccgccccucccgcuguucaucuucagccucaaggacacgcugaagcgccgguccuggccccugaacgagggggugauggccgugggccucgucagcauccuggccuccagccugcuccgcaacgacgugcccauggcgggcccccugguggccgggggccugcucaucgccugcuacgucaucaccgggaccuccgccgaccugaccguggagaaggccgcggacaucacgugggaggaggaggccgagcagaccggcgugagccacaaccugaugaucaccgucgacgacgacgggaccaugcggaucaaggacgacgagaccgagaacauccucacggugcugcugaagaccgcccuccugaucguguccggcaucuucccguacagcauccccgccacccugcucgucuggcacaccuggcagaagcagacgcagcgcuccggcgugcugugggacgugcccagcccgcccgagacccagaaggccgagcuggaggagggggucuaccggaucaagcagcagggcaucuucgggaagacccaggugggcguggggguccagaaggagggcguguuccacaccauguggcacgugacgcgcggcgcgguccucaccuacaacgggaagcggcuggagcccaacugggccuccgugaagaaggaccugaucagcuacggcgggggcuggcgccucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgggagggcaagguggucgggcuguacggcaacgggguggugacgaagaacggcggguacgucuccggcaucgcccagaccaacgccgagccggacggccccacccccgagcuggaggaggagauguucaagaagcgcaaccucaccaucauggaccugcaccccgggagcggcaagacgcggaaguaccugccggccaucgugcgcgaggcgaucaagcggcgccuccggacccugauccuggcccccacccgcguggucgccgccgagauggaggaggcccucaaggggcugcccauccgguaccagaccacggcgaccaaguccgagcacaccggccgcgagaucguggaccugaugugccacgccaccuucacgaugcggcuccugagccccgugcgcgucccgaacuacaaccugaucaucauggacgaggcccacuucaccgaccccgccuccaucgccgcgcggggguacaucagcacccgcgugggcaugggcgaggccgccgccaucuucaugaccgcgacgccgcccgggaccgccgacgccuucccgcaguccaacgcccccauccaggacgaggagcgcgacauccccgagcggagcuggaacuccggcaacgaguggaucaccgacuucgccgggaagaccgugugguucguccccagcaucaaggcgggcaacgacaucgccaacugccuccgcaagaacgggaagaaggugauccagcugucccggaagacguucgacaccgaguaccagaagaccaagcugaacgacugggacuucguggucaccacggacaucagcgagaugggcgccaacuucaaggccgaccgcgugaucgacccgcggcgcugccucaagcccgugauccugaccgacggccccgagcgggucauccuggccgggcccaugccggugaccgcggccuccgccgcccagcgccggggccgcguggggcggaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgcgagaaguccgccgccaucgacggcgaguaccggcugaagggcgagucccgcaagaccuucgucgagcugaugcggcgcggggaccuccccguguggcuggcgcacaaggucgccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcacguacuccgacccgcuggcccucaaggaguucaaggaguucgccgcgggccgcaagagcaucgcccuggaccuggugaccgagaucgggcgcguccccucccaccucgcccaccggacccgcaacgcccuggacaaccuggugaugcuccacaccagcgagcacggcgggcgggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccaccaagcgcgaccugggcauguccaaggagccggggguggucagccccacguccuaccuggacguggaccuccaccccgccagcgccuggacccuguacgccguggcgaccaccgucaucacgcccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgcgaggcccagaagcggaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacccuggccacgggccccaucaccacccucugggagggcucccccgggaaguucuggaacaccacgaucgcggucagcauggccaacaucuuccggggcuccuaccuggccggggccggccuggccuucagcaucaugaaguccguggggaccggcaagcgcggcaccgggagccagggcgagacccucggggagaaguggaagcggaagcugaaccagcugagccgcaaggacuucgaccucuacaagaaguccggcaucaccgagguggaccggacggaggcgaaggaggggcugaagcgcggcgagaucacccaccacgccgucagccggggcuccgccaagcugcagugguucguggagcgcaacauggugaucccggaggggcgggucaucgaccucggcugcgggcgcggcggguggagcuacuacugcgccggccugaagaaggugaccgaggugcgcggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccggaccauccgcgugcugaagaugguggagccguggcucaagaacaaccaguucugcaucaagguccugaaccccuacaugcccacggugaucgagcaccuggagcggcuccagcgcaagcacggcgggaugcuggugcggaacccccugucccgcaacagcacccacgagauguacuggaucuccaacggcaccgggaacaucgucgccagcgugaacauggugucccggcuccugcugaaccgcuucaccaugacgcaccggcgcccgaccaucgagaaggacgucgaccucggcgcgggcacccggcacgugaacgccgagcccgagacccccaacauggacgugaucggggagcgcaucaagcggaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcgcguguucaaggagaagguggacacgcggaccccgcgcagcaugcccggcacccggcgcgucaugggcaucaccgccgaguggcucuggcggacgcuggggcgcaacaagaagccccgccugugcacccgggaggaguucaccaagaaggugcgcaccaacgccgccaugggcgcgguguucacggaggagaaccagugggacuccgccaaggccgccgucgaggacgaggacuucuggaagcucguggaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaagguggugaagguccagcgccccacccccaccggcaccgugauggacaucaucagccggaaggaccagcgcggcuccggccaggugggcacguacgggcugaacaccuucaccaacauggaggcccagcucauccggcagauggagggcgaggggguccugagcaaggccgaccuggagaacccccaccucccggagaagaagaucacccaguggcuggagacgaagggcguggagcgccugaagcggauggcgaucuccggcgacgacugcguggucaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcccgcaucagccagggggcgggcuggucccucaaggagaccgccugccugggcaaggccuacgcccagauguggagccugauguacuuccaccggcgcgaccuccggcuggcguccaacgccaucugcagcgccgugcccguccacugggugccgaccucccgcaccacguggagcauccacgcccaccaccaguggaugaccaccgaggacaugcugaccguguggaaccgggucuggaucgaggacaaccccuggauggaggacaagacgcccgugaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10034 - RNA, 9873 nt, Artificial Sequence
  derived and/or modified CDS sequence (opt1) from DENV-3__HQ705621__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaucuaccagcuguggaccgcccugaucagccucacgugcuccaacaccaucuucacccugaccgucgccuggcgcacggccacccugauccucgccggggugagccugcugccgaugugccaguccagcuccaugcggaagaccgacuggcuccccauggcggucgccgccaugggcgugccgccccucccgcuguucaucuucagccucaaggacacccugaagcgccgcuccuggccccugaacgagggggugauggccgucggccucgugagcauccuggccuccagccugcuccggaacgacgugcccauggcgggcccccuggucgccgggggccugcucaucgccugcuacgugaucacggggaccuccgccgaccugaccguggagaaggccgcggacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcaucuucccguacagcauccccgccacccugcucguguggcacaccuggcagaagcagacccagcgguccggcgugcugugggacguccccagcccgcccgagacgcagaaggccgagcuggaggaggggguguaccgcaucaagcagcagggcaucuucgggaagacccaggugggcgucggggugcagaaggagggcguguuccacaccauguggcacgucacccggggcgcggugcucacguacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagaccacgaccggggagaucggcgcgaucgcccuggacuucaagcccgggaccagcggcagccccaucaucaaccgcgagggcaaggucguggggcuguacggcaacgggguggucaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggccaucgugcgggaggcgaucaagcgccggcuccgcacgcugauccuggcccccacccgggucguggccgccgagauggaggaggcccucaaggggcugcccauccgcuaccagaccaccgcgacgaaguccgagcacaccggccgggagaucguggaccugaugugccacgccaccuucaccaugcgccuccugagccccguccgggugccgaacuacaaccugaucaucauggacgaggcccacuucacggaccccgccuccaucgccgcgcgcggguacaucagcacccgggugggcaugggcgaggccgccgccaucuucaugaccgcgacgccgcccgggacggccgacgccuucccgcaguccaacgcccccauccaggacgaggagcgcgacauccccgagcgcagcuggaacuccggcaacgaguggaucaccgacuucgccgggaagaccgucugguucgugcccagcaucaaggcgggcaacgacaucgccaacugccuccggaagaacgggaagaaggugauccagcugucccgcaagaccuucgacacggaguaccagaagaccaagcugaacgacugggacuucgucgugaccaccgacaucagcgagaugggcgccaacuucaaggccgaccgggugaucgacccgcgccggugccucaagcccgucauccugacggacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagucccggaagacguucguggagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcccucaaggaguucaaggaguucgccgcgggccgcaagagcaucgcccuggaccuggucacggagaucgggcgggugcccucccaccucgcccaccgcacccggaacgcccuggacaaccuggugaugcuccacaccagcgagcacggcgggcgcgccuaccggcacgcggucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcgcacgccccaggacaaccagcuggccuacguggugaucgggauccucacgcuggccgccaucaucgccgcgaacgagaugggccugcucgagaccaccaagcgggaccugggcauguccaaggagccgggggucgugagccccaccuccuaccuggacguggaccuccaccccgccagcgccuggacgcuguacgccgucgcgaccaccgugaucacccccaugcugcgccacacgaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugaccgccgccgugcuccugcugaucacgcacuacgccaucaucggccccggccuccaggcgaaggccacccgggaggcccagaagcgcaccgccgccgggaucaugaagaacccgaccguggacggcaucaugacgaucgaccuggaccccgucaucuacgacuccaaguucgagaagcagcugggccaggugaugcuccuggugcugugcgucgugcagcuccugcugaugcggaccagcugggcgcucugcgaggcccugacccuggccaccggccccaucacgacccucugggagggcucccccgggaaguucuggaacaccaccaucgccgugagcauggcgaacaucuuccgcggcuccuaccuggccggggccggccuggccuucagcaucaugaaguccgucgggacgggcaagcggggcaccgggagccagggcgagacccucggggagaaguggaagaagaagcugaaccagcugagccgcaaggacuucgaccucuacaagaaguccggcaucaccgagguggaccggaccgaggccaaggaggggcugaagcgcggcgagaucacgcaccacgcggugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacgcacgagauguacuggaucuccaacggcaccgggaacaucguggccagcgucaacauggugucccggcuccugcugaaccgcuucaccaugacccaccggcgcccgacgaucgagaaggacguggaccucggcgccggcacccggcacgucaacgcggagcccgagacccccaacauggacgugaucggggagcgcaucaagcggaucaaggaggagcacaacagcaccuggcaccacgacgacgagaacccguacaagacgugggccuaccacggcuccuacgaggugaaggccaccgggagcgccuccagcaugaucaacggcgucgugaagcugcugaccaagcccugggacgucgugcccauggugacccagauggccaugacggacaccacccccuucgggcagcagcgcgucuucaaggagaagguggacacccggacgccgcgcagcaugcccggcacccggcgcgugaugggcaucaccgcggaguggcucuggcggacccuggggcgcaacaagaagccccggcugugcacgcgcgaggaguucaccaagaagguccgcaccaacgccgccaugggcgccguguucaccgaggagaaccagugggacuccgcgaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgccaucugguacauguggcugggcgcgcgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacacggccgggugggacacccgcaucaccgaggacgaccugcacaacgaggagaagaucacccagcagauggacccggagcaccggcagcucgcgaacgccaucuucaagcugacguaccagaacaaggucgugaaggugcagcgccccacccccaccggcaccgucauggacaucaucagccggaaggaccagcgcggcuccggccaggugggcaccuacgggcugaacacguucaccaacauggaggcccagcucauccggcagauggagggcgagggggugcugagcaaggccgaccuggagaacccccaccucccggagaagaagaucacccaguggcuggagaccaagggcgucgagcgccugaagcggauggccaucuccggcgacgacugcguggugaagcccaucgacgaccgcuucgcgaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggccggcuggucccucaaggagacggcgugccugggcaaggccuacgcccagauguggagccugauguacuuccaccgccgcgaccuccggcuggccuccaacgcgaucugcagcgccgugcccgugcacugggucccgaccucccgcaccaccuggagcauccacgcccaccaccaguggaugacgaccgaggacaugcugaccguguggaaccggguguggaucgaggacaaccccuggauggaggacaagacccccgucacgaccugggagaacgugcccuaccucgggaagcgcgaggaccaguggugcggcagccugaucgggcugaccucccgggccaccugggcccagaacaucccgacggcgauccagcagguccgcagccucaucggcaacgaggaguuccuggacuacaugcccuccaugaagcgguuccgcaaggaggaggagagcgagggggccaucugguga

SEQ ID NO: 10035 - RNA, 9873 nt, Artificial Sequence
  derived and/or modified CDS sequence (opt1) from DENV-3__HQ671176__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaucuaccagcuguggaccgcccugaucagccucacgugcuccaacaccaucuucacccugaccgucgccuggcgcacggccacccugauccucgccggggugagccugcugccgaugugccaguccagcuccaugcggaagaccgacuggcuccccauggcggucgccgccaugggcgugccgccccucccgcuguucaucuucagccucaaggacacccugaagcgccgcuccuggccccugaacgagggggugauggccgucggccucgugagcauccuggccuccagccugcuccggaacgacgugcccauggcgggcccccuggucgccgggggccugcucaucgccugcuacgugaucacggggaccuccgccgaccugaccguggagaaggccgcggacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcaucuucccguacagcauccccgccacccugcucguguggcacaccuggcagaagcagacccagcgguccggcgugcugugggacguccccagcccgcccgagacgcagaaggccgagcuggaggaggggguguaccgcaucaagcagcagggcaucuucgggaagacccaggugggcgucggggugcagaaggagggcguguuccacaccauguggcacgucacccggggcgcggugcucacguacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagaccacgaccggggagaucggcgcgaucgcccuggacuucaagcccgggaccagcggcagccccaucaucaaccgcgagggcaaggucguggggcuguacggcaacgggguggucaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggccaucgugcgggaggcgaucaagcgccggcuccgcacgcugauccuggcccccacccgggucguggccgccgagauggaggaggcccucaaggggcugcccauccgcuaccagaccaccgcgacgaaguccgagcacaccggccgggagaucguggaccugaugugccacgccaccuucaccaugcgccuccugagccccguccgggugccgaacuacaaccugaucgugauggacgaggcccacuucacggaccccgccuccaucgccgcgcgcggguacaucagcacccgggucggcaugggcgaggccgccgccaucuucaugaccgcgacgccgcccgggacggccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagucccggaagacguucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggaguucgccgcgggccgcaagagcaucgcccuggaccuggugacggagaucgggcgggugcccucccaccucgcccaccgcacccggaacgcccuggacaaccuggucaugcuccacaccagcgagcacggcgggcgcgccuaccggcacgcgguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacgcuggccgccaucaucgccgcgaacgagaugggccugcucgagaccaccaagcgggaccugggcauguccaaggagccggggguggugagccccaccuccuaccuggacgucgaccuccaccccgccagcgccuggacgcuguacgccguggcgaccaccgugaucacccccaugcugcgccacacgaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugaccgccgccgugcuccugcugaucacgcacuacgccaucaucggccccggccuccaggcgaaggccacccgggaggcccagaagcgcaccgccgccgggaucaugaagaacccgaccgucgacggcaucaugacgaucgaccuggaccccgugaucuacgacuccaaguucgagaagcagcugggccaggugaugcuccugguccugugcgcggugcagcuccugcugaugcggaccagcugggcccucugcgaggcccugacccuggccaccggccccaucacgacccucugggagggcucccccgggaaguucuggaacaccaccaucgcggugagcauggccaacaucuuccgcggcuccuaccuggccggggccggccuggccuucagcaucaugaaguccgucgggacgggcaagcggggcaccgggagccagggcgagacccucggggagaaguggaagaagaagcugaaccagcugagccgcaaggacuucgaccucuacaagaaguccggcaucaccgagguggaccggaccgaggcgaaggaggggcugaagcgcggcgagaucacgcaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacgcacgagauguacuggaucuccaacggcaccgggaacaucguggccagcgucaacauggugucccggcuccugcugaaccgcuucaccaugacccaccggcgcccgacgaucgagaaggacguggaccucggcgcgggcacccggcacgucaacgccgagcccgagacccccaacauggacgugaucggggagcgcaucaagcggaucaaggaggagcacaacagcaccuggcacuacgacgacgagaacccguacaagacgugggccuaccacggcuccuacgaggugaaggccaccgggagcgccuccagcaugaucaacggcgucgugaagcugcugaccaagcccugggacgucgugcccauggugacccagauggcgaugacggacaccacccccuucgggcagcagcgcgucuucaaggagaagguggacacccggacgccgcgcagcaugcccggcacccggcgcgugaugggcaucaccgccgaguggcucuggcggacccuggggcgcaacaagaagccccggcugugcacgcgcgaggaguucaccaagaagguccgcaccaacgccgccaugggcgcgguguucaccgaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacacggcggggugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucagccggaaggaccagcgcggcuccggccaggugggcaccuacgggcugaacacguucaccaacauggaggcccagcucauccggcagauggagggcgagggggugcugagcaaggccgaccuggagaacccccaccucccggagaagaagaucacccaguggcuggagaccaagggcgucgagcgccugaagcggauggcgaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggcgggcuggucccucaaggagacggccugccugggcaaggccuacgcccagauguggagccugauguacuuccaccgccgcgaccuccggcuggcguccaacgccaucugcagcgccgugcccgugcacugggucccgaccucccgcaccaccuggagcauccacgcccaccaccaguggaugacgaccgaggacaugcugaccguguggaaccggguguggaucgaggacaaccccuggauggaggacaagacccccgucacgaccugggagaacgugcccuaccucgggaagcgcgaggaccaguggugcggcagccugaucgggcugaccucccgggccaccugggcgcagaacaucccgacggccauccagcagguccgcagccucaucggcaacgaggaguuccuggacuacaugcccuccaugaagcgguuccgcaaggaggaggagagcgagggggccaucugguga

SEQ ID NO: 10036 - RNA, 9873 nt, Artificial Sequence
  derived and/or modified CDS sequence (opt1) from DENV-3__HQ705609__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucgugaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgaaggagcugaaguacuccuggaagaccugggggaaggccaagaucgucaccgccgagacgcagaacagcuccuucaucaucgacggccccaacacccccgagugccccagcgugucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagacgugcaccuggccgaagucccacacccucuggagcaacggcguccuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccguggugaucaccgagaacugcgggacgcgcggccccagccuccggaccaccaccgucuccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaaggucgacaacuucaccaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgucggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacgguggccuggcgcaccgccacccugauccucgccggggucagccugcugccggugugccaguccagcuccaugcggaagaccgacuggcuccccauggcgguggccgccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacaucacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggaguucgccgcgggccgcaagagcaucgcccuggaccuggugaccgagaucgggcggguccccucccaccucgcccaccgcacccggaacgcccuggacaaccuggugaugcuccacaccagcgagcacggcgggcgcgccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcgcacgccccaggacaaccagcuggccuacgucgugaucgggauccucacccuggccgccaucaucgccgcgaacgagaugggccugcucgagaccaccaagcgggaccugggcauguccaaggagccggggguggucagccccacguccuaccuggacguggaccuccaccccgccagcgccuggacccuguacgccguggcgaccaccgucaucacgcccaugcugcgccacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgggaggcccagaagcgcaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcggaccagcugggcccucugcgaggcccugacccuggccacgggccccaucaccacccucugggagggcucccccgggaaguucuggaacaccacgaucgcggucagcauggccaacaucuuccgcggcuccuaccuggccggggccggccuggccuucagcaucaugaaguccguggggaccggcaagcggggcaccgggagccagggcgagacccucggggagaaguggaagaagaagcugaaccagcugagccgcaaggacuucgaccucuacaagaaguccggcaucaccgagguggaccggacggaggcgaaggaggggcugaagcgcggcgagaucacccaccacgccgucagccggggcuccgccaagcugcagugguucguggagcgcaacauggugaucccggaggggcgggucaucgaccucggcugcgggcgcggcggguggagcuacuacugcgccggccugaagaaggugaccgaggugcggggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaucgucgaggagagccgcaccauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugucccgcaacagcacgcacgagauguacuggaucuccaacggcaccgggaacaucgucgccagcgugaacauggugucccggcuccugcugaaccgcuucaccaugacccaccggcgcccgacgaucgagaaggacgucgaccucggcgcgggcacccggcacgugaacgccgagcccgagacccccaacauggacgugaucggggagcgcaucaagcggaucaaggaggagcacaacagcaccuggcacuacgacgacgagaacccguacaagacgugggccuaccacggcuccuacgaggucaaggccaccgggagcgccuccagcaugaucaacggcguggucaagcugcugaccaagcccugggacguggugcccauggucacccagauggcgaugacggacaccacccccuucgggcagcagcgcguguuccgggagaagguggacacccgcacgccgcggagcaugcccggcacccgccgggucaugggcaucaccgccgaguggcucuggcgcacccuggggcggaacaagaagccccgccugugcacgcgcgaggaguucaccaagaaggugcggaccaacgccgccaugggcgcgguguucaccgaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacacggcggggugggacacccggaucaccgaggacgaccugcacaacgaggagaagaucacccagcagauggacccggagcaccgccagcucgccaacgccaucuucaagcugacguaccagaacaagguggugaagguccagcggcccacccccaccggcaccgugauggacaucaucagccgcaaggaccagcggggcuccggccaggugggcaccuacgggcugaacacguucaccaacauggaggcccagcucauccgccagauggagggcgaggggguccugagcaaggccgaccuggagaacccccaccucccggagaagaagaucacccaguggcuggagaccaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccucaaggagacggccugccugggcaaggccuacgcccagauguggagccugauguacuuccaccgccgggaccuccgccuggcguccaacgccaucugcagcgccgugcccguccacugggugccgaccucccggaccaccuggagcauccacgcccaccaccaguggaugacgaccgaggacaugcugaccguguggaaccgcgucuggaucgaggacaaccccuggauggaggacaagacccccgugacgaccugggagaacgugcccuaccucgggaagcgggaggaccaguggugcggcagccugaucgggcugaccucccgcgccaccugggcgcagaacaucccgacggccauccagcagguccggagccucaucggcaacgaggaguuccuggacuacaugcccuccaugaagcgcuuccggaaggaggaggagagcgagggggccaucugguga

SEQ ID NO: 10037 - RNA, 9873 nt, Artificial Sequence
  derived and/or modified CDS sequence (opt1) from DENV-3__HQ705610__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacaccaucuggagcaacggcgugcucgaguccgacaugaucauccccaagagccuggcggggcccaucucccagcacaaccaccggccgggcuaccacacccagacggccgggcccuggcaccugggcaagcucgagcuggacuucaacuacugcgagggcaccaccgucgugaucaccgagaacugcgggacgcgcggccccagccugcggaccaccaccguguccgggaagcucauccacgaguggugcugccgcagcugcacgcugcccccgcugcgguacaugggcgaggacgggugcugguacggcauggagauccgccccaucuccgagaaggaggagaacauggucaagagccucguguccgccggcagcgggaagguggacaacuucaccaugggcguccugugccuggccauccucuucgaggaggugaugcgggggaaguucggcaagaagcacaugaucgccgggguguuccugaccuucguccugcuccuguccggccagaucaccuggaaggacauggcgcacacgcugaucaugaucggcagcaacgccuccgaccgcauggggaugggcgugaccuaccucgcccugaucgccaccuucaagauccagcccuuccuggcccucggguucuuccugcggaagcugaccagccgcgagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucagcacccugacggucgccuggcggaccgccacccugauccucgccggggugucccugcugccggucugccagagcuccagcaugcgcaagaccgacuggcuccccauggcgguggccgccaugggcgugccgccccucccgcuguucaucuucucccucaaggacacgcugaagcggcgcagcuggccccugaacgagggggucauggccgugggccucguguccauccuggccagcucccugcuccgcaacgacguccccauggcgggcccccugguggccgggggccugcucaucgccugcuacgugaucaccgggaccagcgccgaccugaccgucgagaaggccgcggacaucacgugggaggaggaggccgagcagaccggcgugucccacaaccugaugaucaccguggacgacgacgggaccaugcggaucaaggacgacgagaccgagaacauccucacgguccugcugaagaccgcccuccugaucgugagcggcaucuucccguacuccauccccgccacccugcucguguggcacaccuggcagaagcagacgcagcgcagcggcguccugugggacgugcccagcccgcccgagacccagaaggccgagcuggaggaggggguguaccggaucaagcagcagggcaucuucgggaagacccaggucggcgugggggugcagaaggagggcgucuuccacaccauguggcacgugacgcgcggcgcggugcucaccuacaacgggaagcggcuggagcccaacugggccagcgucaagaaggaccugaucuccuacggcgggggcuggcgccucagcgcccaguggcagaagggggaggagguccaggugaucgccgucgagcccggcaagaaccccaagaacuuccagaccaugcccggcaccuuccagacgaccaccggggagaucggcgcgaucgcccuggacuucaagcccgggaccagcggcucccccaucaucaaccgggagggcaaggugguggggcuguacggcaacggggucgugacgaagaacggcggguacgugagcggcaucgcccagaccaacgccgagccggacggccccacccccgagcuggaggaggagauguucaagaagcgcaaccucaccaucauggaccugcaccccggguccggcaagacgcggaaguaccugccggccaucguccgcgaggcgaucaagcggcgccuccggacccugauccuggcccccacccgcgugguggccgccgagauggaggaggcccucaaggggcugcccauccgguaccagaccacggcgaccaagagcgagcacaccggccgcgagaucgucgaccugaugugccacgccaccuucacgaugcggcuccugucccccgugcgcgugccgaacuacaaccugaucaucauggacgaggcccacuucaccgaccccgccagcaucgccgcgcggggguacaucuccacccgcgucggcaugggcgaggccgccgccaucuucaugaccgcgacgccgcccgggaccgccgacgccuucccgcagagcaacgcccccauccaggacgaggagcgggacauccccgagcgcuccuggaacagcggcaacgaguggaucaccgacuucgccgggaagaccgugugguucgugcccuccaucaaggcgggcaacgacaucgccaacugccuccgcaagaacgggaagaaggucauccagcugagccggaagacguucgacaccgaguaccagaagaccaagcugaacgacugggacuucguggugaccacggacaucuccgagaugggcgccaacuucaaggccgaccgcgucaucgacccgcggcgcugccucaagcccgugauccugaccgacggccccgagcgggugauccuggccgggcccaugccggucaccgcggccagcgccgcccagcgccggggccgcguggggcggaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgcgagaaguccgccgccaucgacggcgaguaccggcugaagggcgagagccgcaagaccuucguggagcugaugcggcgcggggaccuccccgucuggcuggcgcacaagguggccuccgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccggacguacagcgacccgcuggcccucaaggaguucaaggaguucgccgcgggccgcaaguccaucgcccuggaccuggugaccgagaucgggcgcgugcccagccaccucgcccaccggacccgcaacgcccuggacaaccuggucaugcuccacaccagcgagcacggcgggcgggccuaccgccacgcgguggaggagcugcccgagacgauggagacccugcuccugcugggccucaugauccugcugaccgggggcgccaugcuguuccugaucuccggcaaggggaucggcaagaccagcaucgggcugaucugcgugaucgccuccagcggcaugcucuggauggccgagaucccgcugcaguggaucgccuccgcgaucguccuggaguucuucaugauggugcuccugauccccgagcccgagaagcagcggacgccccaggacaaccagcuggccuacguggucaucgggauccucacccuggccgccaucaucgccgcgaacgagaugggccugcucgagaccaccaagcgcgaccugggcaugagcaaggagccggggguggugucccccacgagcuaccuggacgucgaccuccaccccgccuccgccuggacccuguacgccguggcgaccaccgugaucacgcccaugcugcggcacaccaucgagaacagcaccgccaacgucucccucgccgccaucgccaaccaggcgguggugcugaugggccuggacaagggguggccgaucagcaagauggaccucggcgucccccugcuggcccucgggugcuacucccaggugaacccccugacccugacggccgccgugcuccugcugaucacccacuacgccaucaucggccccggccuccaggcgaaggccacccgcgaggcccagaagcggaccgccgccgggaucaugaagaacccgacggucgacggcaucaugaccaucgaccuggaccccgugaucuacgacagcaaguucgagaagcagcugggccaggugaugcuccugguccugugcguggugcagcuccugcugaugcgcaccuccugggcgcucugcgaggcccugacccuggccacgggccccaucaccacccucugggagggcagccccgggaaguucuggaacaccacgaucgccgucuccauggcgaacaucuuccggggcagcuaccuggccggggccggccuggccuucuccaucaugaaguccguggggaccggcaagcgcggcaccgggagccagggcgagacccucggggagaaguggaagaagaagcugaaccagcugucccggaaggacuucgaccucuacaagaaguccggcaucaccgagguggaccgcacggaggccaaggaggggcugaagcggggcgagaucacccaccacgcggucucccgcggcagcgccaagcugcagugguucguggagcggaacauggugaucccggaggggcgcgucaucgaccucggcugcgggcggggcgggugguccuacuacugcgccggccugaagaaggugaccgaggugcgcggcuacaccaagggcgggcccgggcacgaggagcccguccccaugagcacguacggcuggaacaucgugaagcugauguccgggaaggacguguucuaccucccgcccgagaagugcgacacccugcugugcgacaucggcgagagcucccccagccccaccgucgaggagucccggaccauccgcgugcugaagaugguggagccguggcucaagaacaaccaguucugcaucaagguccugaaccccuacaugcccacggugaucgagcaccuggagcgccuccagcggaagcacggcgggaugcuggugcgcaacccccugagccggaacuccacccacgagauguacuggaucagcaacggcaccgggaacaucgucgccuccgugaacauggugagccgccuccugcugaaccgguucaccaugacgcaccgccggccgaccaucgagaaggacgucgaccucggcgccggcacccgccacgugaacgcggagcccgagacccccaacauggacgugaucggggagcggaucaagcgcaucaaggaggagcacaacuccacguggcacuacgacgacgagaacccguacaagaccugggccuaccacggcagcuacgaggucaaggccaccggguccgccagcagcaugaucaacggcguggucaagcugcugaccaagcccugggacguggugcccauggucacgcagauggccaugaccgacaccacccccuucgggcagcagcggguguucaaggagaagguggacacgcgcaccccgcgguccaugcccggcacccgccgggucaugggcaucaccgcggaguggcucuggcgcacgcuggggcggaacaagaagccccgccugugcacccgggaggaguucaccaagaaggugcgcaccaacgccgccaugggcgccguguucacggaggagaaccagugggacagcgcgaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggccaucugguacauguggcugggcgcgcgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacaccgccgggugggacacccggaucaccgaggacgaccugcacaacgaggagaagaucacgcagcagauggacccggagcaccgccagcucgcgaacgccaucuucaagcugaccuaccagaacaagguggugaagguccagcggcccacccccaccggcaccgugauggacaucaucucccgcaaggaccagcggggcagcggccaggugggcacguacgggcugaacaccuucaccaacauggaggcccagcucauccgccagauggagggcgaggggguccuguccaaggccgaccuggagaacccccaccucccggagaagaagaucacccaguggcuggagacgaagggcguggagcggcugaagcgcauggccaucagcggcgacgacugcguggucaagcccaucgacgaccgguucgcgaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcccgcaucucccagggggccggcuggagccucaaggagaccgcgugccugggcaaggccuacgcccagauguggucccugauguacuuccaccggcgcgaccuccgccuggccagcaacgcgaucugcuccgccgugcccguccacugggugccgaccagccggaccacguggagcauccacgcccaccaccaguggaugaccaccgaggacaugcugaccguguggaaccgcgucuggaucgaggacaaccccuggauggaggacaagacgcccgugaccaccugggagaacgugcccuaccucgggaagcgggaggaccaguggugcggcucccugaucgggcugaccagccgcgccacgugggcccagaacaucccgaccgcgauccagcagguccggucccucaucggcaacgaggaguuccuggacuacaugcccagcaugaagcgcuuccggaaggaggaggaguccgagggggccaucugguga

SEQ ID NO: 10038 - RNA, 9873 nt, Artificial Sequence
  derived and/or modified CDS sequence (opt1) from DENV-3__HQ705611__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucgggcucaaggacacgcugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugaccgucgagaaggccgcggacaucacgugggaggaggaggccgagcagaccggggugucccacaaccugaugaucaccguggacgacgacggcaccaugcgcaucaaggacgacgagaccgagaacauccucacgguccugcugaagaccgcccuccugaucgugagcggcaucuucccguacuccauccccgccacccugcucguguggcacaccuggcagaagcagacgcagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacaccauguggcacgugacgcgcggggcggugcucaccuacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggaccuuccagacgaccaccggcgagaucggggcgaucgcccuggacuucaagcccggcaccuccggcagccccaucaucaaccgcgaggggaagguggugggccuguacgggaacggcgucgugacgaagaacgggggcuacgugagcggcaucgcccagaccaacgccgagccggacgggcccacccccgagcuggaggaggagauguucaagaagcggaaccucaccaucauggaccugcaccccggcuccgggaagacgcgcaaguaccugccggccaucguccgggaggcgaucaagcgccggcuccgcacccugauccuggcccccacccgggugguggccgccgagauggaggaggcccucaagggccugcccauccgcuaccagaccacggcgaccaagagcgagcacaccgggcgggagaucgucgaccugaugugccacgccaccuucacgaugcgccuccugucccccgugcgggugccgaacuacaaccugaucaucauggacgaggcccacuucaccgaccccgccagcaucgccgcgcgcggcuacaucuccacccgggucggcaugggggaggccgccgccaucuucaugaccgcgacgccgcccggcaccgccgacgccuucccgcagagcaacgcccccauccaggacgaggagcgcgacauccccgagcgcuccuggaacagcgggaacgaguggaucaccgacuucgccggcaagaccgugugguucgugcccuccaucaaggcggggaacgacaucgccaacugccuccggaagaacggcaagaaggucauccagcugagccgcaagacguucgacaccgaguaccagaagaccaagcugaacgacugggacuucguggugaccacggacaucuccgagaugggcgccaacuucaaggccgaccgggucaucgacccgcgccggugccucaagcccgugauccugaccgacgggcccgagcgcgugauccuggccggccccaugccggucaccgcggccagcgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacgcccgagggcaucaucccggcccucuucgagcccgagcgggagaaguccgccgccaucgacggcgaguaccgccugaagggggagagccggaagaccuucguggagcugaugcgccggggcgaccuccccgucuggcuggcgcacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcacguacagcgacccgcuggcccucaaggaguucaaggaguucgccgcggggcgcaaguccaucgcccuggaccuggugaccgagaucggccgggugcccagccaccucgcccaccgcacccggaacgcccuggacaaccuggucaugcuccacaccuccgagcacgggggccgcgccuaccggcacgcgguggaggagcugcccgagacgauggagacccugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgccuccgcgaucguccuggaguucuucaugauggugcuccugauccccgagcccgagaagcagcgcacgccccaggacaaccagcuggccuacguggucaucggcauccucacccuggccgccaucaucgccgcgaacgagaugggccugcucgagaccaccaagcgggaccuggggaugagcaaggagccgggcguggugucccccacgagcuaccuggacgucgaccuccaccccgccuccgccuggacccuguacgccguggcgaccaccgugaucacgcccaugcugcgccacaccaucgagaacagcaccgccaacgucucccucgccgccaucgccaaccaggcgguggugcugauggggcuggacaagggcuggccgaucagcaagauggaccucggggucccccugcuggcccucggcugcuacucccaggugaacccccugacccugacggccgccgugcuccugcugaucacccacuacgccaucaucggccccgggcuccaggcgaaggccacccgggaggcccagaagcgcaccgccgccggcaucaugaagaacccgacggucgacgggaucaugaccaucgaccuggaccccgugaucuacgacagcaaguucgagaagcagcugggccaggugaugcuccugguccugugcgcggugcagcuccugcugaugcggaccuccugggcccucugcgaggcccugacccuggccacgggccccaucaccacccucugggaggggagccccggcaaguucuggaacaccacgaucgcgguguccauggccaacaucuuccgcgggagcuaccuggccggcgccgggcuggccuucuccaucaugaaguccgucggcaccggcaagcgggggaccggcucccagggggagacccucggcgagaaguggaagaagaagcugaaccagcugagccgcaaggacuucgaccucuacaagaaguccgggaucaccgagguggaccggacggaggcgaaggagggccugaagcgcggcgagaucacccaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacaccaagggcgggcccggccacgaggagcccgugcccaugagcacguacggguggaacaucgucaagcugauguccggcaaggacguguucuaccucccgcccgagaagugcgacacccugcugugcgacaucggcgagagcucccccagccccaccguggaggagucccgcaccauccgcguccugaagaugguggagccguggcucaagaacaaccaguucugcaucaaggugcugaaccccuacaugcccacggucaucgagcaccuggagcggcuccagcgcaagcacgggggcaugcuggugcggaacccccugagccgcaacuccacccacgagauguacuggaucagcaacgggaccggcaacaucguggccuccgucaacauggugagccggcuccugcugaaccgcuucaccaugacgcaccggcgcccgaccaucgagaaggacguggaccucggcgcggggacccggcacgucaacgccgagcccgagacccccaacauggacgugaucggcgagcgcaucaagaagaucaaggaggagcacaacuccacguggcacuacgacgacgagaacccguacaagaccugggccuaccacgggagcuacgaggugaaggccaccggcuccgccagcuccaugaucaacggggucgugaagcugcugaccaagcccugggacgucgugcccauggugacgcagauggcgaugaccgacaccacccccuucggccagcagcgggucuucaaggagaagguggacacgcgcaccccgcggagcaugcccggcacccgccgggugauggggaucaccgccgaguggcucuggcgcacgcugggccggaacaagaagccccgccugugcacccgggaggaguucaccaagaagguccgcaccaacgccgccaugggggcgguguucacggaggagaaccagugggacagcgccaaggccgccguggaggacgaggacuucuggaagcucgucgaccgcgagcgggagcugcacaagcugggcaagugcggguccugcguguacaacaugaugggcaagcgcgagaagaagcucggcgaguucgggaaggccaagggcagccgggcgaucugguacauguggcugggggcccgcuaccuggaguucgaggcccucggcuuccugaacgaggaccacugguucucccgggagaacagcuacuccgggguggagggcgagggccugcacaagcucggguacauccugcgcgacaucagcaagauccccggcggggccauguacgccgacgacaccgcgggcugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaccggcaccgucauggacaucaucucccgcaaggaccagcgggggagcggccagguggggacguacggccugaacaccuucaccaacauggaggcccagcucauccgccagauggagggggagggcgugcuguccaaggccgaccuggagaacccccaccucccggagaagaagaucacccaguggcuggagacgaagggcgucgagcggcugaagcgcauggcgaucagcggggacgacugcguggugaagcccaucgacgaccgguucgccaacgcccuccuggcccugaacgacaugggcaagguccgcaaggacaucccccaguggcagcccuccaagggguggcacgacuggcagcaggucccguucugcagccaccacuuccacgagcucaucaugaaggacggccggaagcuggugguccccugccgcccccaggacgagcugaucgggcgggcccgcaucucccagggcgcgggcuggagccucaaggagaccgccugccuggggaaggccuacgcccagauguggucccugauguacuuccaccggcgcgaccuccgccuggcgagcaacgccaucugcuccgccgugcccgugcacugggucccgaccagccggaccacgugguccauccacgcccaccaccaguggaugaccaccgaggacaugcugaccguguggaaccgcguguggaucgaggacaaccccuggauggaggacaagacgcccgucaccaccugggagaacgugcccuaccucggcaagcgggaggaccaguggugcgggagccugaucggccugaccagccgcgccacgugggcgcagaacaucccgaccgccauccagcagguccggucccucaucgggaacgaggaguuccuggacuacaugcccagcaugaagcgcuuccggaaggaggaggaguccgagggcgccaucugguga

SEQ ID NO: 10039 - RNA, 9873 nt, Artificial Sequence
  derived and/or modified CDS sequence (opt1) from DENV-3__HQ705612__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucgggcucaaggacacgcugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugaccgucgagaaggccgcggacacgaccugggaggaggaggccgagcagaccggggugucccacaaccugaugaucaccguggacgacgacggcaccaugcgcaucaaggacgacgagacggagaacauccucaccguccugcugaagaccgcccuccugaucgugagcggcaucuucccguacuccauccccgccacccugcucguguggcacacguggcagaagcagacccagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacacgauguggcacgugacccgcggggcggugcucacccacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggacguuccagaccaccaccggcgagaucggggcgaucgcccuggacuucaagcccggcacguccggcagccccaucaucaaccgcgaggggaagguggugggccuguacgggaacggcgucgugaccaagaacgggggcuacgugagcggcaucgcccagaccaacgccgagccggacgggcccacccccgagcuggaggaggagauguucaagaagcggaaccucacgaucauggaccugcaccccggcuccgggaagacccgcaaguaccugccggccaucguccgggaggcgaucaagcgccggcuccgcacccugauccuggcccccacccgggugguggccgccgagauggaggaggcccucaagggccugcccauccgcuaccagacgaccgcgaccaagagcgagcacaccgggcgggagaucgucgaccugaugugccacgccacguucaccaugcgccuccugucccccgugcgggugccgaacuacaaccugaucaucauggacgaggcccacuucaccgaccccgccagcaucgccgcgcgcggcuacaucuccacccgggucggcaugggggaggccgccgccaucuucaugacggcgacgccgcccggcaccgccgacgccuucccgcagagcaacgcccccauccaggacgaggagcgcgacauccccgagcgcuccuggaacagcgggaacgaguggaucaccgacuucgccggcaagacggugugguucgugcccuccaucaaggcggggaacgacaucgccaacugccuccggaagaacggcaagaaggucauccagcugagccgcaagaccuucgacaccgaguaccagaagaccaagcugaacgacugggacuucguggugacgaccgacaucuccgagaugggcgccaacuucaaggccgaccgggucaucgacccgcgccggugccucaagcccgugauccugaccgacgggcccgagcgcgugauccuggccggccccaugccggucaccgcggccagcgccgcccagcggcgcgggcgggugggccgcaacccccagaaggagaacgaccaguacaucuucaccgggcagccccucaacaacgacgaggaccacgcccacuggacggaggcgaagaugcugcuggacaacaucaacacccccgagggcaucaucccggcccucuucgagcccgagcgggagaaguccgccgccaucgacggcgaguaccgccugaagggggagagccggaagaccuucguggagcugaugcgccggggcgaccuccccgucuggcuggcgcacaagguggccuccgaggggaucaaguacaccgaccgcaaguggugcuucgacggccagcggaacaaccagauccuggaggagaacauggacgucgagaucuggacgaaggagggcgagaagaagaagcuccgcccccgguggcuggacgcccgcaccuacagcgacccgcuggcccucaaggaguucaaggaguucgccgcggggcgcaaguccaucgcccuggaccuggugaccgagaucggccgggugcccagccaccucgcccaccgcacccggaacgcccuggacaaccuggucaugcuccacacguccgagcacgggggccgcgccuaccggcacgcgguggaggagcugcccgagaccauggagacccugcuccugcuggggcucaugauccugcugaccggcggcgccaugcuguuccugaucagcgggaagggcaucgggaagacgagcaucggccugaucugcgugaucgccuccagcgggaugcucuggauggccgagaucccgcugcaguggaucgccuccgcgaucguccuggaguucuucaugauggugcuccugauccccgagcccgagaagcagcgcacgccccaggacaaccagcuggccuacguggucaucggcauccucacccuggccgccaucaucgccgcgaacgagaugggccugcucgagaccacgaagcgggaccuggggaugagcaaggagccgggcguggugucccccaccagcuaccuggacgucgaccuccaccccgccuccgccuggacccuguacgccguggcgaccacggugaucacccccaugcugcgccacaccaucgagaacagcaccgccaacgucucccucgccgccaucgccaaccaggcgguggugcugauggggcuggacaagggcuggccgaucagcaagauggaccucggggucccccugcuggcccucggcugcuacucccaggugaacccccugacgcugaccgccgccgugcuccugcugaucacccacuacgccaucaucggccccgggcuccaggcgaaggccacccgggaggcccagaagcgcacggccgccggcaucaugaagaacccgaccgucgacgggaucaugaccaucgaccuggaccccgugaucuacgacagcaaguucgagaagcagcugggccaggugaugcuccugguccugugcgcggugcagcuccugcugaugcggaccuccugggcccucugcgaggcccugacgcuggccaccggccccaucaccacccucugggaggggagccccggcaaguucuggaacacgaccaucgcgguguccauggccaacaucuuccgcgggagcuaccuggccggcgccgggcuggccuucuccaucaugaaguccgucggcaccggcaagcgggggaccggcucccagggggagacccucggcgagaaguggaagaagaagcugaaccagcugagccgcaaggacuucgaccucuacaagaaguccgggaucacggagguggaccggaccgaggcgaaggagggccugaagcgcggcgagaucacccaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacacgaagggcgggcccggccacgaggagcccgugcccaugagcaccuacggguggaacaucgucaagcugauguccggcaaggacguguucuaccucccgcccgagaagugcgacacccugcugugcgacaucggcgagagcucccccagccccaccguggaggagucccgcacgauccgcguccugaagaugguggagccguggcucaagaacaaccaguucugcaucaaggugcugaaccccuacaugcccaccgucaucgagcaccuggagcggcuccagcgcaagcacgggggcaugcuggugcggaacccccugagccgcaacuccacccacgagauguacuggaucagcaacgggaccggcaacaucguggccuccgucaacauggugagccggcuccugcugaaccgcuucacgaugacccaccggcgcccgaccaucgagaaggacguggaccucggcgcggggacccggcacgucaacgccgagcccgagacgcccaacauggacgugaucggcgagcgcaucaagcggaucaaggaggagcacaacuccaccuggcacuacgacgacgagaacccguacaagaccugggccuaccacgggagcuacgaggugaaggccaccggcuccgccagcuccaugaucaacggggucgugaagcugcugacgaagcccugggacgucgugcccauggugacccagauggcgaugaccgacaccacgcccuucggccagcagcgcgucuucaaggagaagguggacacccggaccccgcgcagcaugcccggcacccggcgcgugauggggaucacggccgaguggcucuggcggacccugggccgcaacaagaagccccggcugugcacccgcgaggaguucaccaagaagguccgcacgaacgccgccaugggggcgguguucaccgaggagaaccagugggacagcgccaaggccgccguggaggacgaggacuucuggaagcucgucgaccgggagcgcgagcugcacaagcugggcaagugcggguccugcguguacaacaugaugggcaagcgggagaagaagcucggcgaguucgggaaggccaagggcagccgcgcgaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgccgacgacaccgcgggcugggacacccgcaucacggaggacgaccugcacaacgaggagaagaucacccagcagauggacccggagcaccggcagcucgccaacgccaucuucaagcugaccuaccagaacaaggucgugaaggugcagcgccccacccccaccggcacggucauggacaucaucucccggaaggaccagcgcgggagcggccagguggggaccuacggccugaacaccuucaccaacauggaggcccagcucauccggcagauggagggggagggcgugcuguccaaggccgaccuggagaacccccaccucccggagaagaagaucacgcaguggcuggagaccaagggcgucgagcgccugaagcggauggcgaucagcggggacgacugcguggugaagcccaucgacgaccgcuucgccaacgcccuccuggcccugaacgacaugggcaagguccggaaggacaucccccaguggcagcccuccaagggguggcacgacuggcagcaggucccguucugcagccaccacuuccacgagcucaucaugaaggacggccgcaagcuggugguccccugccggccccaggacgagcugaucgggcgcgcccggaucucccagggcgcgggcuggagccucaaggagaccgccugccuggggaaggccuacgcccagauguggucccugauguacuuccaccgccgcgaccuccggcuggcgagcaacgccaucugcuccgccgugcccgugcacugggucccgaccagccgcacgaccugguccauccacgcccaccaccaguggaugaccaccgaggacaugcugacgguguggaaccggguguggaucgaggacaaccccuggauggaggacaagacccccgucaccaccugggagaacgugcccuaccucggcaagcgcgaggaccaguggugcgggagccugaucggccugacgagccgggccaccugggcgcagaacaucccgaccgccauccagcagguccgcucccucaucgggaacgaggaguuccuggacuacaugcccagcaugaagcgguuccgcaaggaggaggaguccgagggcgccaucugguga

SEQ ID NO: 10040 - RNA, 9873 nt, Artificial Sequence
  derived and/or modified CDS sequence (opt1) from DENV-3__HQ705613__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucgggcucaaggacacgcugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugaccgucgagaaggccgcggacaucacgugggaggaggaggccgagcagaccggggugucccacaaccugaugaucaccguggacgacgacggcaccaugcgcaucaaggacgacgagaccgagaacauccucacgguccugcugaagaccgcccuccugaucgugagcggcaucuucccguacuccauccccgccacccugcucguguggcacaccuggcagaagcagacgcagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacaccauguggcacgugacgcgcggggcggugcucaccuacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuaccagaccaugcccgggaccuuccagacgaccaccggcgagaucggggcgaucgcccuggacuucaagcccggcaccuccggcagccccaucaucaaccgcgaggggaagguggugggccuguacgggaacggcgucgugacgaagaacgggggcuacgugagcggcaucgcccagaccaacgccgagccggacgggcccacccccgagcuggaggaggagauguucaagaagcggaaccucaccaucauggaccugcaccccggcuccgggaagacgcgcaaguaccugccggccaucguccgggaggcgaucaagcgccggcuccgcacccugauccuggcccccacccgggugguggccgccgagauggaggaggcccucaagggccugcccauccgcuaccagaccacggcgaccaagagcgagcacaccgggcgggagaucgucgaccugaugugccacgccaccuucacgacccgccuccugucccccgugcgggugccgaacuacaaccugaucaucauggacgaggcccacuucaccgaccccgccagcaucgccgcgcgcggcuacaucuccacccgggucggcaugggggaggccgccgccaucuucaugacggcgacgccgcccggcaccgccgacgccuucccgcagagcaacgcccccauccaggacgaggagcgcgacauccccgagcgcuccuggaacagcgggaacgaguggaucaccgacuucgccggcaagacggugugguucgugcccuccaucaaggcggggaacgacaucgccaacugccuccggaagaacggcaagaaggucauccagcugagccgcaagaccuucgacaccgaguaccagaagaccaagcugaacgacugggacuucguggugacgaccgacaucuccgagaugggcgccaacuucaaggccgaccgggucaucgacccgcgccggugccucaagcccgugauccugaccgacgggcccgagcgcgugauccuggccggccccaugccggucaccgcggccagcgccgcccagcggcgcgggcgggugggccgcaacccccagaaggagaacgaccaguacaucuucaccgggcagccccucaacaacgacgaggaccacgcccacuggacggaggcgaagaugcugcuggacaacaucaacacccccgagggcaucaucccggcccucuucgagcccgagcgggagaaguccgccgccaucgacggcgaguaccgccugaagggggagagccggaagaccuucguggagcugaugcgccggggcgaccuccccgucuggcuggcgcacaagguggccuccgaggggaucaaguacaccgaccgcaaguggugcuucgacggccagcggaacaaccagauccuggaggagaacauggacgucgagaucuggacgaaggagggcgagaagaagaagcuccgcccccgguggcuggacgcccgcaccuacagcgacccgcuggcccucaaggaguucaaggaguucgccgcggggcgcaaguccaucgcccuggaccuggugaccgagaucggccgggugcccagccaccucgcccaccgcacccggaacgcccuggacaaccuggucaugcuccacacguccgagcacgggggccgcgccuaccggcacgcgguggaggagcugcccgagaccauggagacccugcuccugcuggggcucaugauccugcugaccggcggcgccaugcuguuccugaucagcgggaagggcaucgggaagacgagcaucggccugaucugcgugaucgccuccagcgggaugcucuggauggccgagaucccgcugcaguggaucgccuccgcgaucguccuggaguucuucaugauggugcuccugauccccgagcccgagaagcagcgcacgccccaggacaaccagcuggccuacguggucaucggcauccucacccuggccgccaucaucgccgcgaacgagaugggccugcucgagaccacgaagcgggaccuggggaugagcaaggagccgggcguggugucccccaccagcuaccuggacgucgaccuccaccccgccuccgccuggacccuguacgccguggcgaccacggugaucacccccaugcugcgccacaccaucgagaacagcaccgccaacgucucccucgccgccaucgccaaccaggcgguggugcugauggggcuggacaagggcuggccgaucagcaagauggaccucggggucccccugcuggcccucggcugcuacucccaggugaacccccugacgcugaccgccgccgugcuccugcugaucacccacuacgccaucaucggccccgggcuccaggcgaaggccacccgggaggcccagaagcgcacggccgccggcaucaugaagaacccgaccgucgacgggaucaugaccaucgaccuggaccccgugaucuacgacagcaaguucgagaagcagcugggccaggugaugcuccugguccugugcgcggugcagcuccugcugaugcggaccuccugggcccucugcgaggcccugacgcuggccaccggccccaucaccacccucugggaggggagccccggcaaguucuggaacacgaccaucgcgguguccauggccaacaucuuccgcgggagcuaccuggccggcgccgggcuggccuucuccaucaugaaguccgucggcaccggcaagcgggggaccggcucccagggggagacccucggcgagaaguggaagaagaagcugaaccagcugagccgcaaggacuucgaccucuacaagaaguccgggaucacggagguggaccggaccgaggcgaaggagggccugaagcgcggcgagaucacccaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacacgaagggcgggcccggccacgaggagcccgugcccaugagcaccuacggguggaacaucgucaagcugauguccggcaaggacguguucuaccucccgcccgagaagugcgacacccugcugugcgacaucggcgagagcucccccagccccaccguggaggagucccgcacgauccgcguccugaagaugguggagccguggcucaagaacaaccaguucugcaucaaggugcugaaccccuacaugcccaccgucaucgagcaccuggagcggcuccagcgcaagcacgggggcaugcuggugcggaacccccugagccgcaacuccacccacgagauguacuggaucagcaacgggaccggcaacaucguggccuccgucaacauggugagccggcuccugcugaaccgcuucacgaugacccaccggcgcccgaccaucgagaaggacguggaccucggcgcggggacccggcacgucaacgccgagcccgagacgcccaacauggacgugaucggcgagcgcaucaagcggaucaaggaggagcacaacuccaccuggcacuacgacgacgagaacccguacaagaccugggccuaccacgggagcuacgaggugaaggccaccggcuccgccagcuccaugaucaacggggucgugaagcugcugacgaagcccugggacgucgugcccauggugacccagauggcgaugaccgacaccacgcccuucggccagcagcgcgucuucaaggagaagguggacacccggaccccgcgcagcaugcccggcacccggcgcgugauggggaucacggccgaguggcucuggcggacccugggccgcaacaagaagccccggcugugcacccgcgaggaguucaccaagaagguccgcacgaacgccgccaugggggcgguguucaccgaggagaaccagugggacagcgccaaggccgccguggaggacgaggacuucuggaagcucgucgaccgggagcgcgagcugcacaagcugggcaagugcggguccugcguguacaacaugaugggcaagcgggagaagaagcucggcgaguucgggaaggccaagggcagccgcgcgaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgccgacgacaccgcgggcugggacacccgcaucacggaggacgaccugcacaacgaggagaagaucacccagcagauggacccggagcaccggcagcucgccaacgccaucuucaagcugaccuaccagaacaaggucgugaaggugcagcgccccacccccaccggcacggucauggacaucaucucccggaaggaccagcgcgggagcggccagguggggaccuacggccugaacaccuucaccaacauggaggcccagcucauccggcagauggagggggagggcgugcuguccaaggccgaccuggagaacccccaccucccggagaagaagaucacgcaguggcuggagaccaagggcgucgagcgccugaagcggauggcgaucagcggggacgacugcguggugaagcccaucgacgaccgcuucgccaacgcccuccuggcccugaacgacaugggcaagguccggaaggacaucccccaguggcagcccuccaagggguggcacgacuggcagcaggucccguucugcagccaccacuuccacgagcucaucaugaaggacggccgcaagcuggugguccccugccggccccaggacgagcugaucgggcgcgcccggaucucccagggcgcgggcuggagccucaaggagaccgccugccuggggaaggccuacgcccagauguggucccugauguacuuccaccgccgcgaccuccggcuggcgagcaacgccaucugcuccgccgugcccgugcacugggucccgaccagccgcacgaccugguccauccacgcccaccaccaguggaugaccaccgaggacaugcugacgguguggaaccggguguggaucgaggacaaccccuggauggaggacaagacccccgucaccaccugggagaacgugcccuaccucggcaagcgcgaggaccaguggugcgggagccugaucggccugacgagccgggccaccugggcgcagaacaucccgaccgccauccagcagguccgcucccucaucgggaacgaggaguuccuggacuacaugcccagcaugaagcgguuccgcaaggaggaggaguccgagggcgccaucugguga

SEQ ID NO: 10041 - RNA, 9873 nt, Artificial Sequence
  derived and/or modified CDS sequence (opt1) from DENV-3__HQ705615__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacaucacgugggaggaggaggccgagcagaccggcgugagccacaaccugaugaucgccguggacgacgacgggaccaugcgcaucaaggacgacgagaccgagaacauccucaccguccugcugaagacggcccuccugaucguguccggcaucuucccguacagcauccccgccacccugcucguguggcacaccuggcagaagcagacccagcgguccggcguccugugggacgugcccagcccgcccgagacgcagaaggcggagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggcgaucguccgggaggccaucaagcgccggcuccgcacgcugauccuggcccccacccgggugguggccgccgagauggaggaggcgcucaaggggcugcccauccgcuaccagaccaccgccacgaaguccgagcacaccggccgggagaucgucgaccugaugugccacgccaccuucaccaugcgccuccugagccccgugcgggugccgaacuacaaccugaucaucauggacgaggcccacuucacggaccccgccuccaucgcggcccgcggguacaucagcacccgggucggcaugggcgaggccgccgcgaucuucaugaccgccacgccgcccgggacggccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagacguucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggaguucgcggccggccgcaagagcaucgcccuggaccuggugacggagaucgggcgggugcccucccaccucgcccaccgcacccggaacgcccuggacaaccuggucaugcuccacaccagcgagcacggcgggcgcgcguaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgugaucaccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagaccaccaagcgggaccugggcauguccaaggagccggggguggugagccccacguccuaccuggacgucgaccuccaccccgccagcgccuggacccuguacgccguggcgaccaccgugaucacgcccaugcugcgccacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugacggccgccgugcuccugcugaucacccacuacgccaucaucggccccggccuccaggcgaaggccacccgggaggcccagaagcgcaccgccgccgggaucaugaagaacccgacggucgacggcaucaugaccaucgaccuggaccccgugaucuacgacuccaaguucgagaagcagcugggccaggugaugcuccugguccugugcgcggugcagcuccugcugaugcggaccagcugggcccucugcgaggcccugacccuggccacgggccccaucaccacccucugggagggcucccccgggaaguucuggaacaccacgaucgcggugagcauggccaacaucuuccgcggcuccuaccuggccggggccggccuggccuucagcaucaugaaguccgucgggaccggcaagcggggcaccgggagccagggcgagacccucggggagaaguggaagaagaagcugaaccagcugagccgcaaggacuucgaccucuacaagaaguccggcaucaccgagguggaccggacggaggcgaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuaccacugcgccggccugaagaaggucaccgaggugcggggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccgcaccauccgcguccugaagaugguggagccguggcucaagaacaaccaguucugcaucaaggugcugaaccccuacaugcccacggucaucgagcaccuggagcggcuccagcgcaagcacggcgggaugcuggugcggaacccccugucccgcaacagcacccacgagauguacuggaucuccaacggcaccgggaacaucguggccagcgucaacauggugucccggcuccugcugaaccgcuucaccaugacgcaccggcgcccgaccaucgagaaggacguggaccucggcgcgggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgucgugcccauggugacgcagauggcgaugaccgacaccacccccuucgggcagcagcgcgucuucaaggagaagguggacacgcggaccccgcgcagcaugcccggcacccggcgcgugaugggcaucaccgccgaguggcucuggcggacgcuggggcgcaacaagaagccccggcugugcacccgcgaggaguucaccaagaagguccgcaccaacgccgccaugggcgcgguguucacggaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcccagcucauccggcagauggagggcgagggggugcugagcaaggccgaccuggagaacccccaccucccggagaagaagaucacccaguggcuggagacgaagggcgucgagcgccugaagcggauggcgaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggcgggcuggucccucaaggagaccgccugccugggcaaggccuacgcccagauguggagccugauguacuuccaccgccgcgaccuccggcuggcguccaacgccaucugcagcgccgugcccgugcacugggucccgaccucccgcaccacguggagcauccacgcccaccaccaguggaugaccaccgacgacaugcugaccguguggaaccggguguggaucgaggacaaccccuggauggaggacaagacgcccgucaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10042 - RNA, 9873 nt, Artificial Sequence
  derived and/or modified CDS sequence (opt1) from DENV-3__JF920398__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacaccaucuggagcaacggcgugcucgaguccgacaugaucauccccaagagccuggcggggcccaucucccagcacaaccaccggccgggcuaccacacccagacggccgggcccuggcaccugggcaagcucgagcuggacuucaacuacugcgagggcaccaccgucgugaucaccgagaacugcgggacgcgcggccccagccugcggaccaccaccguguccgggaagcucauccacgaguggugcugccgcagcugcacgcugcccccgcugcgguacaugggcgaggacgggugcugguacggcauggagauccgccccaucuccgagaaggaggagaacauggucaagagccucguguccgccggcagcgggaagguggacaacuucaccaugggcguccugugccuggccauccucuucgaggaggugaugcgggggaaguucggcaagaagcacaugaucgccgggguguuccugaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacaucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccggcguccugugggacgugcccagcccgcccgagacccagaaggccgagcuggaggaggggguguaccgcaucaagcagcagggcaucuucgggaagacccaggucggcgugggggugcagaaggagggcgucuuccacaccauguggcacgugacgcggggcgcggugcucaccuacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucguccgggaggcgaucaagcgccggcuccgcacccugauccuggcccccacccgggugguggccgccgagauggaggaggcccucaaggggcugcccauccgcuaccagaccacggcgaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggguacaucagcacccgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggaguucgccgcgggccgcaagagcaucgcccuggaccuggugaccgagaucgggcgggugcccucccaccucgcccaccgcacccggaacgcccuggacaaccuggucaugcuccacaccagcgagcacggcgggcgcgccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagaccaccaagcgggaccugggcauguccaaggagccggggguggugagccccacguccuaccuggacgucgaccuccaccccgccagcgccuggacccuguacgccguggcgaccaccgugaucacgcccaugcugcgccacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugacggccgccgugcuccugcugaucacccacuacgccaucaucggccccggccuccaggcgaaggccacccgggaggcccagaagcgcaccgccgccgggaucaugaagaacccgacggucgacggcaucaugaccaucgaccuggaccccgugaucuacgacuccaaguucgagaagcagcugggccaggugaugcuccugguccugugcgcggugcagcuccugcugaugcggaccagcugggcccucugcgaggcccugacccuggccacgggccccaucaccacccucugggagggcucccccgggaaguucuggaacaccacgaucgcggugagcauggccaacaucuuccgcggcuccuaccuggccggggccggccuggccuucagcaucaugaaguccgucgggaccggcaagcggggcaccgggagccagggcgagacccucggggagaaguggaagaagaagcugaaccagcugagccgcaaggacuucgaccucuacaagaaguccggcaucaccgagguggaccggacggaggcgaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccgcaccauccgcguccugaagaugguggagccguggcucaagaacaaccaguucugcaucaaggugcugaaccccuacaugcccacggucaucgagcaccuggagcggcuccagcgcaagcacggcgggaugcuggugcggaacccccugucccgcaacagcacccacgagauguacuggaucuccaacggcaccgggaacaucguggccagcgucaacauggugucccggcuccugcugaaccgcuucaccaugacgcaccggcgcccgaccaucgagaaggacguggaccucggcgcgggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgucgugcccauggugacgcagauggcgaugaccgacaccacccccuucgggcagcagcgcgucuucaaggagaagguggacacgcggaccccgcgcagcaugcccggcacccggcgcgugaugggcaucaccgccgaguggcucuggcggacgcuggggcgcaacaagaagccccggcugugcacccgcgaggaguucaccaagaagguccgcaccaacgccgccaugggcgcgguguucacggaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcccagcucauccggcagauggagggcgagggggugcugagcaaggccgaccuggagaacccccaccucccggagaagaagaucacccaguggcuggagacgaagggcgucgagcgccugaagcggauggcgaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggcgggcuggucccucaaggagaccgccugccugggcaaggccuacgcccagauguggagccugauguacuuccaccgccgcgaccuccggcuggcguccaacgccaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10043 - RNA, 9873 nt, Artificial Sequence
  derived and/or modified CDS sequence (opt1) from DENV-3__JF920402__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcggggcccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaucuaccagcuguggaccgcccugaucagccugaccugcuccaacacgaucuucacccugaccgucgccuggcgcaccgccacgcugauccucgcgggggugagccugcugccgaugugccaguccagcuccaugcggaagaccgacuggcuccccauggccgucgccgccaugggcgugccgccccucccgcuguucaucuucagccucaaggacacccugaagcgccgcuccuggccccugaacgagggggugauggccgucggccucgugagcauccuggcguccagccugcuccggaacgacgugcccauggccggcccccuggucgccgggggccugcucaucgccugcuacgugaucaccgggacguccgccgaccugaccguggagaaggcggccgacaucaccugggaggaggaggccgagcagaccggcgucagccacaaccugaugaucacgguggacgacgacgggaccaugcgcaucaaggacgacgagaccgagaacauccucaccgugcugcugaagaccgcccuccugaucgucuccggcaucuucccguacagcauccccgccacgcugcucguguggcacaccuggcagaagcagacccagcgguccggcgugcugugggacguccccagcccgcccgagacccagaaggcggagcuggaggaggggguguaccgcaucaagcagcagggcaucuucgggaagacccaggugggcgucggggugcagaaggagggcguguuccacaccauguggcacgucacccggggcgccgugcucaccuacaacgggaagcgccuggagcccaacugggccuccgugaagaaggaccugaucagcuacggcgggggcuggcggcucuccgcccaguggcagaagggggaggagguccaggugaucgcgguggagcccggcaagaaccccaagaacuuccagacgaugcccggcaccuuccagaccaccacgggggagaucggcgccaucgcccuggacuucaagcccgggaccagcggcagccccaucaucaaccgcgagggcaaggucguggggcuguacggcaacgggguggucaccaagaacggcggguacguguccggcaucgcccagaccaacgccgagccggacggccccacgcccgagcuggaggaggagauguucaagaagcggaaccucaccaucauggaccugcaccccgggagcggcaagacccgcaaguaccugccggcgaucgugcgggaggccaucaagcgccggcuccgcacccugauccuggcccccacgcgggucguggccgccgagauggaggaggcgcucaaggggcugcccauccgcuaccagaccaccgccaccaaguccgagcacacgggccgggagaucguggaccugaugugccacgccaccuucaccaugcgccuccugagccccguccgggugccgaacuacaaccugaucaucauggacgaggcccacuucaccgaccccgccuccaucgcggcccgcggguacaucagcacgcgggugggcaugggcgaggccgccgcgaucuucaugaccgccacgccgcccgggaccgccgacgccuucccgcaguccaacgcccccauccaggacgaggagcgcgacauccccgagcgcagcuggaacuccggcaacgaguggaucacggacuucgcggggaagaccgucugguucgugcccagcaucaaggccggcaacgacaucgccaacugccuccggaagaacgggaagaaggugauccagcugucccgcaagaccuucgacaccgaguaccagaagacgaagcugaacgacugggacuucgucgugaccaccgacaucagcgagaugggcgccaacuucaaggccgaccgggugaucgacccgcgccggugccucaagcccgucauccugaccgacggccccgagcgcgugauccuggcggggcccaugccggugacggccgccuccgccgcccagcggcgcggccgggucgggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagaccuucguggagcugaugcgccgcggggaccuccccguguggcuggcccacaaggucgccagcgagggcaucaaguacacggaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcccucaaggaguucaaggaguucgcggccggccgcaagagcaucgcccuggaccuggucaccgagaucgggcgggugcccucccaccucgcccaccgcacgcggaacgcccuggacaaccuggugaugcuccacaccagcgagcacggcgggcgcgcguaccggcacgccgucgaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugcucuggauggccgagaucccgcugcaguggaucgcgagcgccaucgugcuggaguucuucaugaugguccuccugauccccgagcccgagaagcagcgcacgccccaggacaaccagcuggccuacguggugaucgggauccucacccuggccgccaucaucgcggccaacgagaugggccugcucgagacgaccaagcgggaccugggcauguccaaggagccgggggucgugagccccaccuccuaccuggacguggaccuccaccccgccagcgccuggacccuguacgcggucgccacgaccgugaucacccccaugcugcgccacaccaucgagaacuccacggccaacgugagccucgccgccaucgcgaaccaggccgucgugcugaugggccuggacaagggguggccgaucuccaagauggaccucggcgugccccugcuggcccucgggugcuacagccaggucaacccccugacccugaccgccgccgugcuccugcugaucacccacuacgcgaucaucggccccggccuccaggccaaggccacgcgggaggcccagaagcgcaccgccgcggggaucaugaagaacccgaccguggacggcaucaugaccaucgaccuggaccccgucaucuacgacuccaaguucgagaagcagcugggccaggugaugcuccuggugcugugcgucgugcagcuccugcugaugcggacgagcugggcccucugcgaggcccugacccuggccaccggccccaucaccacgcucugggagggcucccccgggaaguucuggaacaccaccaucgcggugagcauggccaacaucuuccgcggcuccuaccuggccggggccggccuggccuucagcaucaugaaguccgucgggaccggcaagcggggcacggggagccagggcgagacccucggggagaaguggaagaagaagcugaaccagcugagccgcaaggacuucgaccucuacaagaaguccggcaucaccgagguggaccggaccgaggcgaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgccggccugaagaaggucacggaggugcggggcuacaccaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccacgguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacccacgagauguacuggaucuccaacggcacggggaacaucguggccagcgucaacauggugucccggcuccugcugaaccgcuucaccaugacccaccggcgcccgaccaucgagaaggacguggaccucggcgcgggcacgcggcacgucaacgccgagcccgagacccccaacauggacgugaucggggagcgcaucaagcggaucaaggaggagcacaacagcaccuggcacuacgacgacgagaacccguacaagaccugggccuaccacggcuccuacgaggugaaggccacggggagcgccuccagcaugaucaacggcgucgugaagcugcugaccaagcccugggacgucgugcccauggugacccagauggcgaugaccgacacgacccccuucgggcagcagcgcgucuucaaggagaagguggacacccggaccccgcgcagcaugcccggcacgcggcgcgugaugggcaucaccgccgaguggcucuggcggacccuggggcgcaacaagaagccccggcugugcacccgcgaggaguucacgaagaagguccgcaccaacgccgccaugggcgcgguguucaccgaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgcggggugggacacgcgcaucaccgaggacgaccugcacaacgaggagaagaucacccagcagauggacccggagcaccggcagcucgccaacgccaucuucaagcugaccuaccagaacaaggucgugaaggugcagcgccccacgcccaccggcaccgucauggacaucaucagccggaaggaccagcgcggcuccggccaggugggcaccuacgggcugaacaccuucacgaacauggaggcccagcucauccggcagauggagggcgagggggugcugagcaaggccgaccuggagaacccccaccucccggagaagaagaucacccaguggcuggagaccaagggcgucgagcgccugaagcggauggcgaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggcgggcuggucccucaaggagaccgccugccugggcaaggccuacgcccagauguggagccugauguacuuccaccgccgcgaccuccggcuggcguccaacgccaucugcagcgccgugcccgugcacugggucccgacgucccgcaccaccuggagcauccacgcccaccaccaguggaugaccacggaggacaugcugaccguguggaaccggguguggaucgaggacaaccccuggauggaggacaagacccccgucaccacgugggagaacgugcccuaccucgggaagcgcgaggaccaguggugcggcagccugaucgggcugaccucccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10044 - RNA, 9873 nt, Artificial Sequence
  derived and/or modified CDS sequence (opt1) from DENV-3__JF937652__SS-prME
accagccugugccucaugaugauccugcccgccgcccuggcguuccaccucaccagccgggacggcgagccccggaugaucguggggaagaacgagcgcggcaagagccugcuguucaagaccgccuccgggaucaacaugugcacccucaucgccauggaccugggcgagaugugcgacaacaccgugaccuacaagugcccccacaucaccgagguggagcccgaggacaucgacugcuggugcaaccugaccagcaccugggugaccuacgggacgugcaaccaggccggcgagcaccggcgggacaagcgguccguggcccucgcgccccacgugggcauggggcuggacacccgcacccagaccuggaugagcgccgagggcgccuggcggcaggucgagaaggucgagacgugggcccugcgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugcccgaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgguccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgucccgugcaagauccccuucagcacggaggacgggcagggcaaggcgcacaacggccgccugaucaccgccaaccccguggugaccaagaaggaggagcuggucaacaucgaggccgagcccccguucggggagagcaacaucgugaucggcaucggggacaacgcccugaagaucaacugguacaagaagggcuccagcaucgggaagauguucgaggcgaccgcccggggcgcccgccggauggccauccucggcgacacggccugggacuucggguccgugggcgggguccugaacagccugggcaagauggugcaccagaucuucggguccgcguacaccgcccucuucagcggcguguccugggucaugaagaucggcaucggggugcugcugaccuggaucggccucaacagcaagaacaccuccaugagcuucuccugcaucgccaucgggaucaucacgcuguaccugggcgccgugguccaggccgacauggggugcgugaucaacuggaagggcaaggagcucaagugcggcagcgggaucuucgugaccaacgagguccacaccuggaccgagcaguacaaguuccaggcggacucccccaagcgccuggccacggccaucgccggcgccugggagaacggggugugcggcauccgcagcaccacccggauggagaaccugcucuggaagcagaucgcgaacgagcugaacuacauccugugggagaacaacaucaagcucaccguggucgugggggacaucaucggcgugcuggagcagggcaagcgcacgcugacgccccagcccauggagcucaaguacuccuggaagaccugggggaaggccaagaucgucaccgccgagacgcagaacagcuccuucaucaucgacggcccgaacacccccgagugccccagcgugucccgggccuggaacgugugggaggucgaggacuacggguucggcguguucaccaccaacaucuggcugaagcugcgcgagguguacacccagcucugcgaccaccggcugaugagcgcggccgucaaggacgagcgcgccgugcacgccgacaugggcuacuggaucgagagccagaagaacggguccuggaagcuggagaaggccagccucaucgaggugaagacgugcaccuggcccaagucccacacccuguggagcaacggcguccuggaguccgacaugaucauccccaagagccucgcggggcccaucucccagcacaacuaccggcccggcuaccacacccagacggccgggccguggcaccugggcaagcuggagcucgacuucaacuacugcgagggcaccaccguggugaucaccgagaacugcgggacgcgcggccccagccugcggaccaccaccgucuccgggaagcugauccacgaguggugcugccgcagcugcacgcugccgccccuccgguacaugggcgaggacgggugcugguacggcauggagauccgcccgaucuccgagaaggaggagaacauggucaagagccugguguccgccggcagcgggaaggucgacaacuucaccaugggcgugcucugccuggccauccuguucgaggaggugaugcgggggaagcucggcaagaagcacaugaucgccggggucuucuucaccuucgugcugcugcucuccggccagaucaccuggcgcgacauggcgcacacgcugaucaugaucggcagcaacgccuccgaccggauggggaugggcgugaccuaccuggcccucaucgccaccuucaagauccagcccuuccuggcccugggguucuuccuccgcaagcugaccagccgggagaaccugcuccugggcgucggccuggcgauggccacgacccuccagcugcccgaggacaucgagcagauggccaacgggaucgcccugggccucauggcgcugaagcugaucacccaguucgagaccuaccagcucuggacggcccugaucagccugaccugcuccaacaccaucuucacccucacgguggccuggcgcaccgccacccugauccuggccggggucagccuccugcccgugugccaguccagcuccaugcggaagaccgacuggcugccgauggcgguggccgccaugggcgugccgccccugccccuguucaucuucgggcugaaggacacgcucaagcgccgcagcuggccgcugaacgagggcgugauggccgugggccuggucuccauccucgccagcucccugcugcggaacgacgugcccauggcggggccccucguggccggcgggcugcugaucgccugcuacgucaucaccggcaccagcgccgaccucaccguggagaaggccgcggacaucacgugggaggaggaggccgagcagaccggggugucccacaaccugaugaucaccgucgacgacgacggcaccaugcgcaucaaggacgacgagaccgagaacauccugacggugcuccugaagaccgcccugcucaucgugagcggcaucuuccccuacuccaucccggccacccugcuggucuggcacaccuggcagaagcagacgcagcggagcggggugcucugggacgugcccagcccgcccgagacccagaaggccgagcuggaggagggcgucuaccgcaucaagcagcaggggaucuucggcaagacccaggugggggugggcguccagaaggagggcguguuccacaccauguggcacgugacgcgcggggcgguccugaccuacaacggcaagcgccucgagccgaacugggccagcgugaagaaggaccugaucuccuacgggggcggguggcggcugagcgcccaguggcagaagggcgaggaggugcaggucaucgccguggagcccggcaagaaccccaagaacuuccagaccaugcccgggaccuuccagacgaccaccggcgagaucggggcgaucgcccuggacuucaagccgggcaccuccggcagccccaucaucaaccgcgaggggaagguggucggccucuacgggaacggcguggugacgaagaacgggggcuacgucagcggcaucgcccagaccaacgccgagcccgacgggccgacccccgagcuggaggaggagauguucaagaagcggaaccugaccaucauggaccuccaccccggcuccgggaagacgcgcaaguaccugcccgccaucgugcgggaggcgaucaagcgccggcugcgcacccucauccuggccccgacccggguggucgccgccgagauggaggaggcccugaagggccuccccauccgcuaccagaccacggcgaccaagagcgagcacaccgggcgggagaucguggaccugaugugccacgccaccuucacgaugcgccugcucucccccgugcggguccccaacuacaaccugaucaucauggacgaggcccacuucaccgacccggccagcaucgccgcgcgcggcuacaucuccacccgggugggcaugggggaggccgccgccaucuucaugaccgcgacgccgcccggcaccgccgacgccuucccccagagcaacgccccgauccaggacgaggagaaggacauccccgagcgcuccuggaacagcgggaacgaguggaucaccgacuucgccggcaagaccgugugguucguccccuccaucaaggcggggaacgacaucgccaacugccugcgcaagaacggcaagaaggugauccagcucagccggaagacguucgacaccgaguaccagaagaccaagcugaacgacugggacuucguggucaccacggacaucuccgagaugggcgccaacuucaaggccgaccgcgugaucgacccccggcgcugccugaagccggugauccucaccgacgggcccgagcgggucauccuggccggccccaugcccgugaccgcggccagcgccgcccagcgccgggggcgcgugggccggaacccgcagaaggagaacgaccaguacaucuucaccgggcagccccugaacaacgacgaggaccacgcccacuggaccgaggcgaagaugcuccuggacaacaucaacacgcccgagggcaucauccccgcccuguucgagccggagcgcgagaaguccgccgccaucgacggcgaguaccggcucaagggggagagccgcaagaccuucgucgagcugaugcggcgcggcgaccugcccguguggcucgcgcacaaggucgccuccgaggggaucaaguacaccgaccggaaguggugcuucgacggccagcgcaacaaccagauccuggaggagaacauggacguggagaucuggaccaaggagggcgagaagaagaagcugcggccccgcuggcucgacgcccggacguacagcgacccccuggcccugaaggaguucaaggaguucgccgcggggcgcaaguccaucgcccucgaccuggugaccgagaucggccgcgucccgagccaccuggcccaccggacccgcaacgcccucgacaaccuggugaugcugcacaccuccgagcacgggggccgggccuaccgccacgcgguggaggagcuccccgagacgauggagacccugcugcuccuggggcugaugauccuccugaccggcggcgccaugcuguuccucaucagcgggaagggcaucgggaagaccagcaucggccugaucugcgucaucgccuccagcgggaugcuguggauggccgagaucccccuccaguggaucgccuccgcgaucgugcuggaguucuucaugauggugcugcucaucccggagcccgagaagcagcggacgccccaggacaaccagcuggccuacgucgugaucggcauccugacccucgccgccaucaucgccgcgaacgagaugggccugcuggagaccaccaagcgcgaccucgggaugagcaaggagcccggcguggucuccccgacgagcuaccuggacguggaccugcaccccgccuccgccuggacccucuacgccguggcgaccaccgucaucacgcccaugcugcggcacaccaucgagaacagcaccgccaacgugucccuggccgccaucgccaaccaggcggugguccucauggggcuggacaagggcuggcccaucagcaagauggaccugggggugccgcuccuggcccugggcugcuacucccaggugaacccccucacccugacggccgccguccugcuccugaucacccacuacgccaucaucggccccgggcugcaggcgaaggccacccgcgaggcccagaagcggaccgccgccggcaucaugaagaaccccacgguggacgggaucaugaccaucgaccucgacccggugaucuacgacagcaaguucgagaagcagcugggccaggucaugcugcucgugcugugcgcggugcagcugcuccugaugcgcaccuccugggcccugugcgaggcccucacccuggccacgggccccaucaccacccugugggaggggagccccggcaaguucuggaacaccacgaucgcggucuccauggccaacaucuuccgggggagcuaccucgccggcgccgggcuggccuucuccaucaugaaguccgugggcaccggcaagcgcgggaccggcucccagggggagacccugggcgagaaguggaagaagaagcucaaccagcugagccggaaggacuucgaccuguacaagaaguccgggaucaccgagguggaccgcacggaggcgaaggagggccucaagcggggcgagaucacccaccacgccgucucccgcgggagcgccaagcugcagugguucguggagcggaacauggugauccccgagggccgcgucaucgaccuggggugcggccgcgggggcugguccuacuacugcgccggccucaagaaggugaccgaggugcgcggguacaccaagggcgggccgggccacgaggagcccguccccaugagcacguacggguggaacaucgugaagcugauguccggcaaggacguguucuaccugcccccggagaagugcgacacccugcucugcgacaucggcgagagcucccccagccccaccgucgaggagucccggaccauccgcgugcugaagaugguggagcccuggcugaagaacaaccaguucugcaucaagguccucaacccguacaugcccacggugaucgagcaccuggagcgccugcagcggaagcacgggggcaugcucgugcgcaacccccugagccggaacuccacccacgagauguacuggaucagcaacgggaccggcaacaucgucgccuccgugaacauggugagccgccugcuccugaaccgguucaccaugacgcaccgccggcccaccaucgagaaggacgucgaccugggcgcggggacccgccacgugaacgccgagccggagacccccaacauggacgugaucggcgagcggaucaagcgcaucaaggaggagcacaacuccacguggcacuacgacgacgagaaccccuacaagaccugggccuaccacgggagcuacgaggucaaggccaccggcuccgccagcuccaugaucaacgggguggucaagcuccugaccaagccgugggacguggugcccauggucacgcagauggcgaugaccgacaccacccccuucggccagcagcggguguucaaggagaagguggacacgcgcacgccccggagcaugccgggcacccgccgggucauggggaucaccgccgaguggcuguggcgcacccucggccggaacaagaagccccgccugugcacccgggaggaguucaccaagaaggugcgcaccaacgccgccaugggggcgguguucacggaggagaaccagugggacagcgccaaggccgccgucgaggacgaggacuucuggaagcugguggaccgcgagcgggagcuccacaagcugggcaagugcggguccugcguguacaacaugaugggcaagcgcgagaagaagcugggcgaguucgggaaggccaagggcagccgggcgaucugguacauguggcucggggcccgcuaccuggaguucgaggcccugggcuuccucaacgaggaccacugguucucccgggagaacagcuacuccggggucgagggcgagggccugcacaagcugggguacauccuccgcgacaucagcaagauccccggcggggccauguacgccgacgacaccgcgggcugggacacccggaucaccgaggacgaccugcacaacgaggagaagaucacgcagcagauggaccccgagcaccgccagcuggccaacgccaucuucaagcucaccuaccagaacaagguggugaagguccagcggccgacccccaccggcaccgugauggacaucaucucccgcaaggaccagcgggggagcggccagguggggacguacggccugaacaccuucaccaacaugggggcccagcugauccgccagauggagggcgagggcguccucuccaaggccgaccuggagaacccccaccuccccgagaagaagaucacccaguggcucgagacgaaggggguggagcggcugaagcgcauggcgaucagcggcgacgacugcguggucaagccgaucgacgaccgguucgccaacgcccugcucgcccugaacgacauggggaaggugcgcaaggacaucccccaguggcagcccuccaagggcuggcacgacuggcagcagguccccuucugcagccaccacuuccacgagcugaucaugaaggacgggcggaagcucgucgugccgugccgcccccaggacgagcugaucggccgggcccgcaucucccagggcgcgggguggagccugaaggagaccgccugccucggcaaggccuacgcccagauguggucccugauguacuuccaccggcgcgaccugcgccucgcgagcaacgccaucugcuccgccgugcccguccacugggugcccaccagccggaccacgugguccauccacgcccaccaccaguggaugaccaccgaggacaugcugaccguguggaaccgcgucuggaucgaggacaacccguggauggaggacaagacgcccgugaccaccugggagaacgugcccuaccuggggaagcgggaggaccaguggugcggcagccucaucgggcugaccagccgcgccacgugggcgcagaacauccccaccgccauccagcagguccggucccugaucggcaacgaggaguuccucgacuacaugccgagcaugaagcgcuuccggaaggaggaggaguccgagggcgccaucugguga

SEQ ID NO: 10045 - RNA, 9873 nt, Artificial Sequence
  derived and/or modified CDS sequence (opt1) from DENV-3__JF920404__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacgcguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgucucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucgggcucaaggacacccugaagcgccgcagcuggccccugaacgagggcgucauggccgugggccucguguccauccuggcgagcucccugcuccggaacgacguccccauggccgggccccugguggccggcgggcugcucaucgccugcuacgugaucacgggcaccagcgccgaccugaccgucgagaaggcggccgacaucaccugggaggagggggccgagcagacgggcgugucccacaaccugaugaucaccguggacgacgacggcaccaugcgcaucaaggacgacgagaccgagaacauccucaccguccugcugaagacggcccuccugaucgugagcgggaucuucccguacuccauccccgccacccugcucguguggcacaccuggcagaagcagacccagcggagcggcguccugugggacgugcccagcccgcccgagacgcagaaggcggagcuggaggaggggguguaccgcaucaagcagcagggcaucuucgggaagacccaggucggcgugggcgugcagaaggagggggucuuccacaccauguggcacgugacccggggcgccgugcucacguacaacgggaagcgccuggagcccaacugggccagcgucaagaaggaccugaucuccuacggcgggggcuggcggcucagcgcccaguggcagaagggcgaggagguccaggugaucgcggucgagcccgggaagaaccccaagaacuuccagaccaugcccggcaccuuccagaccacgaccggggagaucggcgccaucgcccuggacuucaagcccggcaccuccgggagccccaucaucaaccgcgagggcaaggugguggggcuguacggcaacggggucgugaccaagaacggcggcuacgugagcgggaucgcccagacgaacgccgagccggacggccccacccccgagcuggaggaggagauguucaagaagcggaaccucaccaucauggaccugcaccccggguccggcaagacccgcaaguaccugccggcgaucguccgggaggccaucaagcgccggcuccgcacgcugauccuggcccccacccgggugguggccgccgagauggaggaggcgcucaaggggcugcccauccgcuaccagaccaccgccaccaaguccgagcacaccggccgggagaucgucgaccugaugugccacgccaccuucaccaugcgccuccugucccccgugcgggugccgaacuacaaccugaucaucauggacgaggcccacuucacggaccccgccagcaucgcggcccgcggcuacaucuccacccgggucgggaugggcgaggccgccgcgaucuucaugaccgccacgccgcccgggacggccgacgccuucccgcagagcaacgcccccauccaggacgaggagcgcgacauccccgagcgcuccuggaacagcggcaacgaguggaucaccgacuucgcggggaagaccgugugguucgugcccuccaucaaggccggcaacgacaucgccaacugccuccggaagaacggcaagaaggucauccagcugagccgcaagaccuucgacacggaguaccagaagaccaagcugaacgacugggacuucguggugaccaccgacaucuccgagaugggggccaacuucaaggccgaccgggucaucgacccgcgccggugccucaagcccgugauccugacggacggccccgagcgcgugauccuggcggggcccaugccggucaccgccgccagcgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgagggcaucaucccggcccucuucgagcccgagcgggagaaguccgccgcgaucgacggggaguaccgccugaagggcgagagccggaagacguucguggagcugaugcgccgcggggaccuccccgucuggcuggcccacaagguggccuccgagggcaucaaguacaccgaccgcaaguggugcuucgacggccagcggaacaaccagauccuggaggagaacauggacgucgagaucuggaccaaggagggggagaagaagaagcuccgcccccgguggcuggacgcccgcaccuacagcgacccgcuggcccucaaggaguucaaggaguucgcggccggccgcaaguccaucgcccuggaccuggugacggagaucgggcgggugcccagccaccucgcccaccgcacccggaacgcccuggacaaccuggucaugcuccacaccuccgagcacggcgggcgcgcguaccggcacgccguggaggagcugcccgagaccauggagacgcugcuccugcugggccucaugauccugcugaccggcggggccaugcuguuccugaucagcggcaaggggaucggcaagaccagcaucgggcugaucugcgugaucgccuccagcggcaugcucuggauggccgagaucccgcugcaguggaucgcguccgccaucguccuggaguucuucaugauggugcuccugauccccgagcccgagaagcagcgcacgccccaggacaaccagcuggccuacguggucaucggcauccucacgcuggccgccaucaucgcggccaacgagauggggcugcucgagaccaccaagcgggaccugggcaugagcaaggagccggggguggugucccccaccagcuaccuggacgucgaccuccaccccgccuccgccuggacgcuguacgcgguggccaccaccgugaucacccccaugcugcgccacacgaucgagaacagcaccgccaacgucucccucgccgccaucgcgaaccaggccguggugcugaugggccuggacaagggguggccgaucagcaagauggaccucggcgucccccugcuggcccucggcugcuacucccaggugaacccccugacccugaccgccgccgugcuccugcugaucacgcacuacgcgaucaucgggcccggccuccaggccaaggccacccgggaggcccagaagcgcaccgccgcggggaucaugaagaacccgaccgucgacggcaucaugacgaucgaccuggaccccgugaucuacgacagcaaguucgagaagcagcugggccaggugaugcuccugguccugugcgccgugcagcuccugcugaugcggaccuccugggcccucugcgaggcccugacccuggcgaccgggcccaucacgacccucugggagggcagccccgggaaguucuggaacaccaccaucgccguguccauggccaacaucuuccgcggcagcuaccuggccggggccggccuggcguucuccaucaugaaguccgucggcacggggaagcggggcaccgggucccagggcgagacccucggggagaaguggaagaagaagcugaaccagcugagccgcaaggacuucgaccucuacaagaaguccggcaucaccgagguggaccggaccgaggccaaggagggccugaagcgcggggagaucacgcaccacgccgugucccggggcagcgccaagcugcagugguucgucgagcgcaacauggugaucccggaggggcgggugaucgaccucggcugcgggcgcggcggcugguccuacuacugcgccgggcugaagaaggucaccgaggugcggggcuacaccaagggcgggcccgggcacgaggagcccgugcccaugagcaccuacggcuggaacaucgucaagcugauguccggcaaggacguguucuaccucccgcccgagaagugcgacacgcugcugugcgacaucggggagagcucccccagccccaccguggaggagucccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugagccgcaacuccacgcacgagauguacuggaucagcaacggcaccggcaacaucguggcguccgucaacauggugagccggcuccugcugaaccgcuucaccaugacccaccggcgcccgacgaucgagaaggacguggaccucggggccggcacccggcacgucaacgccgagcccgagacccccaacauggacgugaucggggagcgcaucaagcggaucaaggaggagcacaacuccaccuggcacuacgacgacgagaacccguacaagacgugggccuaccacggcagcuacgaggugaaggccaccggguccgcgagcuccaugaucaacggcgucgugaagcugcugaccaagcccugggacgucgugcccauggugacccagauggccaugacggacaccacccccuucggccagcagcgcgucuucaaggagaagguggacacccggacgccgcgcagcaugcccgggacccggcgcgugaugggcaucaccgccgaguggcucuggcggacccuggggcgcaacaagaagccccggcugugcacgcgcgaggaguucaccaagaagguccgcaccaacgccgcgaugggcgccguguucaccgaggagaaccagugggacagcgccaaggccgccguggaggacgaggacuucuggaagcucgucgaccgggagcgcgagcugcacaagcuggggaagugcggcuccugcguguacaacaugaugggcaagcgggagaagaagcucggggaguucggcaaggcgaaggggagccgcgccaucugguacauguggcugggcgcccgguaccuggaguucgaggcccucggguuccugaacgaggaccacugguucucccgcgagaacagcuacuccggcguggagggcgaggggcugcacaagcucggcuacauccugcgggacaucagcaagauccccgggggcgccauguacgcggacgacacggccggcugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccgggaccgucauggacaucaucucccggaaggaccagcgcggcagcggccaggugggcaccuacgggcugaacacguucaccaacauggaggcccagcucauccggcagauggagggcgagggcgugcuguccaaggcggaccuggagaacccccaccucccggagaagaagaucacccaguggcuggagaccaagggggucgagcgccugaagcggauggccaucagcggcgacgacugcguggugaagcccaucgacgaccgcuucgccaacgcccuccuggcccugaacgacauggggaagguccggaaggacaucccccaguggcagcccuccaagggcuggcacgacuggcagcaggucccguucugcagccaccacuuccacgagcucaucaugaaggacgggcgcaagcuggugguccccugccggccccaggacgagcugaucggccgcgcgcggaucucccagggcgccggguggagccucaaggagacggccugccugggcaaggccuacgcgcagauguggucccugauguacuuccaccgccgcgaccuccggcuggccagcaacgccaucugcuccgccgugcccgugcacugggucccgaccagccgcaccaccugguccauccacgcccaccaccaguggaugacgaccgaggacaugcugaccguguggaaccggguguggaucgaggacaaccccuggauggaggacaagacccccgucacgaccugggagaacgugcccuaccucgggaagcgcgaggaccaguggugcggcagccugaucgggcugaccagccgggcgaccugggcccagaacaucccgacggccauccagcagguccgcucccucaucggcaacgaggaguuccuggacuacaugcccagcaugaagcgguuccgcaaggaggaggaguccgagggcgccaucugguga

SEQ ID NO: 10046 - RNA, 9873 nt, Artificial Sequence
  derived and/or modified CDS sequence (opt1) from DENV-3__JF937641__SS-prME
accagccugugccucaugaugauccugcccgccgcccuggcguuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacgcguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgucucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucgggcucaaggacacccugaagcgccgcagcuggccccugaacgagggcgucauggccgugggccucguguccauccuggcgagcucccugcuccggaacgacguccccauggccgggccccugguggccggcgggcugcucaucgccugcuacgugaucacgggcaccagcgccgaccugaccgucgagaaggcggccgacaucaccugggaggaggaggccgagcagacgggggugucccacaaccugaugaucaccguggacgacgacggcaccaugcgcaucaaggacgacgagaccgagaacauccucaccguccugcugaagacggcccuccugaucgugagcggcaucuucccguacuccauccccgccacccugcucguguggcacaccuggcagaagcagacccagcggagcgggguccugugggacgugcccagcccgcccgagacgcagaaggcggagcuggaggagggcguguaccgcaucaagcagcaggggaucuucggcaagacccaggucggggugggcgugcagaaggagggcgucuuccacaccauguggcacgugacccgcggggccgugcucacguacaacggcaagcgccuggagcccaacugggccagcgucaagaaggaccugaucuccuacgggggcggguggcggcucagcgcccaguggcagaagggcgaggagguccaggugaucgcggucgagcccggcaagaaccccaagaacuuccagaccaugcccgggaccuuccagaccacgaccggcgagaucggggccaucgcccuggacuucaagcccggcaccuccggcagccccaucaucaaccgcgaggggaagguggugggccuguacgggaacggcgucgugaccaagaacgggggcuacgugagcggcaucgcccagacgaacgccgagccggacgggcccacccccgagcuggaggaggagauguucaagaagcggaaccucaccaucauggaccugcaccccggcuccgggaagacccgcaaguaccugccggcgaucguccgggaggccaucaagcgccggcuccgcacgcugauccuggcccccacccgggugguggccgccgagauggaggaggcgcucaagggccugcccauccgcuaccagaccaccgccaccaaguccgagcacaccgggcgggagaucgucgaccugaugugccacgccaccuucaccaugcgccuccugucccccgugcgggugccgaacuacaaccugaucaucauggacgaggcccacuucacggaccccgccagcaucgcggcccgcggcuacaucuccacccgggucggcaugggggaggccgccgcgaucuucaugaccgccacgccgcccggcacggccgacgccuucccgcagagcaacgcccccauccaggacgaggagcgcgacauccccgagcgcuccuggaacagcgggaacgaguggaucaccgacuucgcgggcaagaccgugugguucgugcccuccaucaaggccgggaacgacaucgccaacugccuccggaagaacggcaagaaggucauccagcugagccgcaagaccuucgacacggaguaccagaagaccaagcugaacgacugggacuucguggugaccaccgacaucuccgagaugggcgccaacuucaaggccgaccgggucaucgacccgcgccggugccucaagcccgugauccugacggacgggcccgagcgcgugauccuggcgggccccaugccggucaccgccgccagcgccgcccagcggcgcgggcgggugggccgcaacccccagaaggagaacgaccaguacaucuucaccgggcagccccucaacaacgacgaggaccacgcgcacuggaccgaggccaagaugcugcuggacaacaucaacacccccgagggcaucaucccggcccucuucgagcccgagcgggagaaguccgccgcgaucgacggcgaguaccgccugaagggggagagccggaagacguucguggagcugaugcgccggggcgaccuccccgucuggcuggcccacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcaccuacagcgacccgcuggcccucaaggaguucaaggaguucgcggccgggcgcaaguccaucgcccuggaccuggugacggagaucggccgggugcccagccaccucgcccaccgcacccggaacgcccuggacaaccuggucaugcuccacaccuccgagcacgggggccgcgcguaccggcacgccguggaggagcugcccgagaccauggagacgcugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgcguccgccaucguccuggaguucuucaugauggugcuccugauccccgagcccgagaagcagcgcacgccccaggacaaccagcuggccuacguggucaucggcauccucacgcuggccgccaucaucgcggccaacgagaugggccugcucgagaccaccaagcgggaccuggggaugagcaaggagccgggcguggugucccccaccagcuaccuggacgucgaccuccaccccgccuccgccuggacgcuguacgcgguggccaccaccgugaucacccccaugcugcgccacacgaucgagaacagcaccgccaacgucucccucgccgccaucgcgaaccaggccguggugcugauggggcuggacaagggcuggccgaucagcaagauggaccucggggucccccugcuggcccucggcugcuacucccaggugaacccccugacccugaccgccgccgugcuccugcugaucacgcacuacgcgaucaucggccccgggcuccaggccaaggccacccgggaggcccagaagcgcaccgccgcgggcaucaugaagaacccgaccgucgacgggaucaugacgaucgaccuggaccccgugaucuacgacagcaaguucgagaagcagcugggccaggugaugcuccugguccugugcgccgugcagcuccugcugaugcggaccuccugggcccucugcgaggcccugacccuggcgaccggccccaucacgacccucugggaggggagccccggcaaguucuggaacaccaccaucgccguguccauggccaacaucuuccgcgggagcuaccuggccggcgccgggcuggcguucuccaucaugaaguccgucggcacgggcaagcgggggaccggcucccagggggagacccucggcgagaaguggaagaagaagcugaaccagcugagccgcaaggacuucgaccucuacaagaaguccgggaucaccgagguggaccggaccgaggccaaggagggccugaagcgcggcgagaucacgcaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacaccaagggcgggcccggccacgaggagcccgugcccaugagcaccuacggguggaacaucgucaagcugauguccggcaaggacguguucuaccucccgcccgagaagugcgacacgcugcugugcgacaucggcgagagcucccccagccccaccguggaggagucccgcaccauccgcguccugaagaugguggagccguggcucaagaacaaccaguucugcaucaaggugcugaaccccuacaugcccaccgucaucgagcaccuggagcggcuccagcgcaagcacgggggcaugcuggugcggaacccccugagccgcaacuccacgcacgagauguacuggaucagcaacgggaccggcaacaucguggcguccgucaacauggugagccggcuccugcugaaccgcuucaccaugacccaccggcgcccgacgaucgagaaggacguggaccucggcgccgggacccggcacgucaacgccgagcccgagacccccaacauggacgugaucggcgagcgcaucaagcggaucaaggaggagcacaacuccaccuggcacuacgacgacgagaacccguacaagacgugggccuaccacgggagcuacgaggugaaggccaccggcuccgcgagcuccaugaucaacggggucgugaagcugcugaccaagcccugggacgucgugcccauggugacccagauggccaugacggacaccacccccuucggccagcagcgcgucuucaaggagaagguggacacccggacgccgcgcagcaugcccggcacccggcgcgugauggggaucaccgccgaguggcucuggcggacccugggccgcaacaagaagccccggcugugcacgcgcgaggaguucaccaagaagguccgcaccaacgccgcgaugggggccguguucaccgaggagaaccagugggacagcgccaaggccgccguggaggacgaggacuucuggaagcucgucgaccgggagcgcgagcugcacaagcugggcaagugcggguccugcguguacaacaugaugggcaagcgggagaagaagcucggcgaguucgggaaggcgaagggcagccgcgccaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgcggacgacacggccggcugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucucccggaaggaccagcgcgggagcggccagguggggaccuacggccugaacacguucaccaacauggaggcccagcucauccggcagauggagggggagggcgugcuguccaaggcggaccuggagaacccccaccucccggagaagaagaucacccaguggcuggagaccaagggcgucgagcgccugaagcggauggccaucagcggggacgacugcguggugaagcccaucgacgaccgcuucgccaacgcccuccuggcccugaacgacaugggcaagguccggaaggacaucccccaguggcagcccuccaagggguggcacgacuggcagcaggucccguucugcagccaccacuuccacgagcucaucaugaaggacggccgcaagcuggugguccccugccggccccaggacgagcugaucgggcgcgcgcggaucucccagggcgccggcuggagccucaaggagacggccugccuggggaaggccuacgcgcagauguggucccugauguacuuccaccgccgcgaccuccggcuggccagcaacgccaucugcuccgccgugcccgugcacugggucccgaccagccgcaccaccugguccauccacgcccaccaccaguggaugacgaccgaggacaugcugaccguguggaaccggguguggaucgaggacaaccccuggauggaggacaagacccccgucacgaccugggagaacgugcccuaccucggcaagcgcgaggaccaguggugcgggagccugaucggccugaccagccgggcgaccugggcccagaacaucccgacggccauccagcagguccgcucccucaucgggaacgaggaguuccuggacuacaugcccagcaugaagcgguuccgcaaggaggaggaguccgagggcgccaucugguga

SEQ ID NO: 10047 - RNA, 9873 nt, Artificial Sequence
  derived and/or modified CDS sequence (opt1) from DENV-3__JF920396__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucggggcccuccugaccuggaucggccugaacagcaagaacaccuccaugagcuucuccugcaucgccaucgggaucaucacgcucuaccugggcgccgucgugcaggcggacauggggugcguggucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacggucgccuggcgcaccgccacccugauccucgcgggggugagccugcugccggucugccaguccagcuccaugcggaagaccgacuggcuccccauggccguggccgccaugggcgugccgccccucccgcuguucaucuucagccucaaggacacgcugaagcgccgcuccuggccccugaacgagggggucauggccgugggccucgugagcauccuggcguccagccugcuccggaacgacguccccauggccggcccccugguggccgggggccugcucaucgccugcuacgugaucaccgggaccuccgccgaccugaccgucgagaaggcggccgacaucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagacgaccaccggggagaucggcgccaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggcgaucguccgggaggccaucaagcgccggcuccgcacccugauccuggcccccacccgggugguggccgccgagauggaggaggcgcucaaggggcugcccauccgcuaccagaccacggccaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgcggcccgcggguacaucagcacccgggucggcaugggcgaggccgccgcgaucuucaugaccgccacgccgcccgggaccgccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacgcccgaggggaucaucccggcccucuucgagcccgagcgggagaaguccgccgcgaucgacggcgaguaccgccugaagggcgagucccggaagaccuucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggaguucgcggccggccgcaagagcaucgcccuggaccuggugaccgagaucgggcgggugcccucccaccucgcccaccgcacccggaacgcccuggacaaccuggucaugcuccacaccagcgagcacggcgggcgcgcguaccggcacgccguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucguccuggaguucuucaugauggugcuccugauccccgagcccgagaagcagcgcacgccccaggacaaccagcuggccuacguggucaucgggauccucacccuggccgccaucaucgcggccaacgagaugggccugcucgagaccaccaagcgggaccugggcauguccaaggagccggggguggugagccccacguccuaccuggacgucgaccuccaccccgccagcgccuggacccuguacgcgguggccaccaccgugaucacgcccaugcugcgccacaccaucgagaacuccaccgccaacgucagccucgccgccaucgcgaaccaggccguggugcugaugggccuggacaagggguggccgaucuccaagauggaccucggcgucccccugcuggcccucgggugcuacagccaggugaacccccugacccugacggccgccgugcuccugcugaucacccacuacgcgaucaucggccccggccuccaggccaaggccacccgggaggcccagaagcgcaccgccgcggggaucaugaagaacccgacggucgacggcaucaugaccaucgaccuggaccccgugaucuacgacuccaaguucgagaagcagcugggccaggugaugcuccugguccugugcgccgugcagcuccugcugaugcggaccagcugggcccucugcgaggcccugacccuggcgacgggccccaucaccacccucugggagggcucccccgggaaguucuggaacaccacgaucgccgugagcauggccaacaucuuccgcggcuccuaccuggccggggccggccuggcguucagcaucaugaaguccgucgggaccggcaagcggggcaccgggagccagggcgagacccucggggagaaguggaagaagaagcugaaccagcugagccgcaaggacuucgaccucuacaagaaguccggcaucaccgagguggaccggacggaggccaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccgcaccauccgcguccugaagaugguggagccguggcucaagaacaaccaguucugcaucaaggugcugaaccccuacaugcccacggucaucgagcaccuggagcggcuccagcgcaagcacggcgggaugcuggugcggaacccccugucccgcaacagcacccacgagauguacuggaucuccaacggcaccgggaacaucguggcgagcgucaacauggugucccggcuccugcugaaccgcuucaccaugacgcaccggcgcccgaccaucgagaaggacguggaccucggcgccggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggccaccgggagcgcguccagcaugaucaacggcgucgugaagcugcugaccaagcccugggacgucgugcccauggugacgcagauggccaugaccgacaccacccccuucgggcagcagcgcgucuucaaggagaagguggacacgcggaccccgcgcagcaugcccggcacccggcgcgugaugggcaucaccgccgaguggcucuggcggacgcuggggcgcaacaagaagccccggcugugcacccgcgaggaguucaccaagaagguccgcaccaacgccgcgaugggcgccguguucacggaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgcggacgacaccgccgggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcccagcucauccggcagauggagggcgagggggugcugagcaaggcggaccuggagaacccccaccucccggagaagaagaucacccaguggcuggagacgaagggcgucgagcgccugaagcggauggccaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcgcggaucagccagggggccggcuggucccucaaggagaccgccugccugggcaaggccuacgcgcagauguggagccugauguacuuccaccgccgcgaccuccggcuggccuccaacgccaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucgggaagcgcgaggaccaguggugcggcagccugaucgggcugaccucccgggcgacgugggcccagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10048 - RNA, 9873 nt, Artificial Sequence
  derived and/or modified CDS sequence (opt1) from DENV-3__JF920406__SS-prME
accagccugugccucaugaugauccugcccgccgcccuggcguuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacgcguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgucucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucgagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucgggcucaaggacacccugaagcgccgcagcuggccccugaacgagggcgucauggccgugggccucguguccauccuggcgagcucccugcuccggaacgacguccccauggccgggccccugguggccggcgggcugcucaucgccugcuacgugaucacgggcaccagcgccgaccugaccgucgagaaggcggccgacaucaccugggaggaggaggccgagcagacgggggugucccacaaccugaugaucaccguggacgacgacggcaccaugcgcaucaaggacgacgagaccgagaacauccucaccguccugcugaagacggcccuccugaucgugagcggcaucuucccguacuccauccccgccacccugcucguguggcacaccuggcagaagcagacccagcggagcgggguccugugggacgugcccagcccgcccgagacgcagaaggcggagcuggaggagggcguguaccgcaucaagcagcaggggaucuucggcaagacccaggucggggugggcgugcagaaggagggcgucuuccacaccauguggcacgugacccgcggggccgugcucacguacaacggcaagcgccuggagcccaacugggccagcgucaagaaggaccugaucuccuacgggggcggguggcggcucagcgcccaguggcagaagggcgaggagguccaggugaucgcggucgagcccggcaagaaccccaagaacuuccagaccaugcccgggaccuuccagaccacgaccggcgagaucggggccaucgcccuggacuucaagcccggcaccuccggcagccccaucaucaaccgcgaggggaagguggugggccuguacgggaacggcgucgugaccaagaacgggggcuacgugagcggcaucgcccagacgaacgccgagccggacgggcccacccccgagcuggaggaggagauguucaagaagcggaaccucaccaucauggaccugcaccccggcuccgggaagacccgcaaguaccugccggcgaucguccgggaggccaucaagcgccggcuccgcacgcugauccuggcccccacccgggugguggccgccgagauggaggaggcgcucaagggccugcccauccgcuaccagaccaccgccaccaaguccgagcacaccgggcgggagaucgucgaccugaugugccacgccaccuucaccaugcgccuccugucccccgugcgggugccgaacuacaaccugaucaucauggacgaggcccacuucacggaccccgccagcaucgcggcccgcggcuacaucuccacccgggucggcaugggggaggccgccgcgaucuucaugaccgccacgccgcccggcacggccgacgccuucccgcagagcaacgcccccauccaggacgaggagcgcgacauccccgagcgcuccuggaacagcgggaacgaguggaucaccgacuucgcgggcaagaccgugugguucgugcccuccaucaaggccgggaacgacaucgccaacugccuccggaagaacggcaagaaggucauccagcugagccgcaagaccuucgacacggaguaccagaagaccaagcugaacgacugggacuucguggugaccaccgacaucuccgagaugggcgccaacuucaaggccgaccgggucaucgacccgcgccggugccucaagcccgugauccugacggacgggcccgagcgcgugauccuggcgggccccaugccggucaccgccgccagcgccgcccagcggcgcgggcgggugggccgcaacccccagaaggagaacgaccaguacaucuucaccgggcagccccucaacaacgacgaggaccacgcgcacuggaccgaggccaagaugcugcuggacaacaucaacacccccgagggcaucaucccggcccucuucgagcccgagcgggagaaguccgccgcgaucgacggcgaguaccgccugaagggggagagccggaagacguucguggagcugaugcgccggggcgaccuccccgucuggcuggcccacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcaccuacagcgacccgcuggcccucaaggaguucaaggaguucgcggccgggcgcaaguccaucgcccuggaccuggugacggagaucggccgggugcccagccaccucgcccaccgcacccggaacgcccuggacaaccuggucaugcuccacaccuccgagcacgggggccgcgcguaccggcacgccguggaggagcugcccgagaccauggagacgcugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgcguccgccaucguccuggaguucuucaugauggugcuccugauccccgagcccgagaagcagcgcacgccccaggacaaccagcuggccuacguggucaucggcauccucacgcuggccgccaucaucgcggccaacgagaugggccugcucgagaccaccaagcgggaccuggggaugagcaaggagccgggcguggugucccccaccagcuaccuggacgucgaccuccaccccgccuccgccuggacgcuguacgcgguggccaccaccgugaucacccccaugcugcgccacacgaucgagaacagcaccgccaacgucucccucgccgccaucgcgaaccaggccguggugcugauggggcuggacaagggcuggccgaucagcaagauggaccucggggucccccugcuggcccucggcugcuacucccaggugaacccccugacccugaccgccgccgugcuccugcugaucacgcacuacgcgaucaucggccccgggcuccaggccaaggccacccgggaggcccagaagcgcaccgccgcgggcaucaugaagaacccgaccgucgacgggaucaugacgaucgaccuggaccccgugaucuacgacagcaaguucgagaagcagcugggccaggugaugcuccugguccugugcgccgugcagcuccugcugaugcggaccuccugggcccucugcgaggcccugacccuggcgaccggccccaucacgacccucugggaggggagccccggcaaguucuggaacaccaccaucgccguguccauggccaacaucuuccgcgggagcuaccuggccggcgccgggcuggcguucuccaucaugaaguccgucggcacgggcaagcgggggaccggcucccagggggagacccucggcgagaaguggaagaagaagcugaaccagcugagccgcaaggacuucgaccucuacaagaaguccgggaucaccgagguggaccggaccgaggccaaggagggccugaagcgcggcgagaucacgcaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacaccaagggcgggcccggccacgaggagcccgugcccaugagcaccuacggguggaacaucgucaagcugauguccggcaaggacguguucuaccucccgcccgagaagugcgacacgcugcugugcgacaucggcgagagcucccccagccccaccguggaggagucccgcaccauccgcguccugaagaugguggagccguggcucaagaacaaccaguucugcaucaaggugcugaaccccuacaugcccaccgucaucgagcaccuggagcggcuccagcgcaagcacgggggcaugcuggugcggaacccccugagccgcaacuccacgcacgagauguacuggaucagcaacgggaccggcaacaucguggcguccgucaacauggugagccggcuccugcugaaccgcuucaccaugacccaccggcgcccgacgaucgagaaggacguggaccucggcgccgggacccggcacgucaacgccgagcccgagacccccaacauggacgugaucggcgagcgcaucaagcggaucaaggaggagcacaacuccaccuggcacuacgacgacgagaacccguacaagacgugggccuaccacgggagcuacgaggugaaggccaccggcuccgcgagcuccaugaucaacggggucgugaagcugcugaccaagcccugggacgucgugcccauggugacccagauggccaugacggacaccacccccuucggccagcagcgcgucuucaaggagaagguggacacccggacgccgcgcagcaugcccggcacccggcgcgugauggggaucaccgccgaguggcucuggcggacccugggccgcaacaagaagccccggcugugcacgcgcgaggaguucaccaagaagguccgcaccaacgccgcgaugggggccguguucaccgaggagaaccagugggacagcgccaaggccgccguggaggacgaggacuucuggaagcucgucgaccgggagcgcgagcugcacaagcugggcaagugcggguccugcguguacaacaugaugggcaagcgggagaagaagcucggcgaguucgggaaggcgaagggcagccgcgccaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgcggacgacacggccggcugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucucccggaaggaccagcgcgggagcggccagguggggaccuacggccugaacacguucaccaacauggaggcccagcucauccggcagauggagggggagggcgugcuguccaaggcggaccuggagaacccccaccucccggagaagaagaucacccaguggcuggagaccaagggcgucgagcgccugaagcggauggccaucagcggggacgacugcguggugaagcccaucgacgaccgcuucgccaacgcccuccuggcccugaacgacaugggcaagguccggaaggacaucccccaguggcagcccuccaagggguggcacgacuggcagcaggucccguucugcagccaccacuuccacgagcucaucaugaaggacggccgcaagcuggugguccccugccggccccaggacgagcugaucgggcgcgcgcggaucucccagggcgccggcuggagccucaaggagacggccugccuggggaaggccuacgcgcagauguggucccugauguacuuccaccgccgcgaccuccggcuggccagcaacgccaucugcuccgccgugcccgugcacugggucccgaccagccgcaccaccugguccauccacgcccaccaccaguggaugacgaccgaggacaugcugaccguguggaaccggguguggaucgaggacaaccccuggauggaggacaagacccccgucacgaccugggagaacgugcccuaccucggcaagcgcgaggaccaguggugcgggagccugaucggccugaccagccgggcgaccugggcccagaacaucccgacggccauccagcagguccgcucccucaucgggaacgaggaguuccuggacuacaugcccagcaugaagcgguuccgcaaggaggaggaguccgagggcgccaucugguga

SEQ ID NO: 10049 - RNA, 9873 nt, Artificial Sequence
  derived and/or modified CDS sequence (opt1) from DENV-3__JF920409__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucgcccagaagguggugaucuucauccugcugaugcucgucacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccacgcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgcgaagaagcaggagguggucgugcuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgucucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcgggggccuucuucauguucgugcugcuccuguccggccagaucaccuggcgcgacauggcccacacccugaucaugaucggcagcaacgccuccgaccggauggggaugggcgucaccuaccucgcccugaucgcgacguucaagauccagcccuuccuggcccucggguucuuccugcgcaagcugaccagccgggagaaccuccugcugggcgugggccucgccauggccaccacccugcagcugcccgaggacaucgagcagauggcgaacgggaucgcccucggccugauggcccugaagcucaucacgcaguucgagaccuaccagcuguggaccgcccugaucagccugaccugcuccaacacgaucuucacccugaccguggccuggcgcaccgcgacgcugauccucgccggggucagccugcugccggugugccaguccagcuccaugcggaagaccgacuggcuccccauggccgucgccgccaugggcgugccgccccucccgcuguucaucuucagccucaaggacacccugaagcgccgcuccuggccccugaacgagggggugauggcggucggccucgugagcauccuggccuccagccugcuccggaacgacgugcccauggccggcccccuggucgccgggggccugcucaucgccugcuacgugaucaccgggacguccgcggaccugaccguggagaaggccgccgacaucaccugggaggaggaggccgagcagaccggcgucagccacaaccugaugaucacgguggacgacgacgggaccaugcgcaucaaggacgacgaguccgagaacauccucaccgugcugcugaagaccgcccuccugaucgucagcggcaucuucccguacuccauccccgcgacccugcucguguggcacacguggcagaagcagacccagcggagcggcgugcugugggacguccccagcccgcccgagacccagaaggccgagcuggaggaggggguguaccgcaucaagcagcagggcaucuucgggaagacccaggugggcgucggggugcagaaggagggcguguuccacacgauguggcacgucacccggggcgccgugcucaccuacaacgggaagcgccuggagcccaacugggccagcgugaagaaggaccugaucuccuacggcgggggcuggcggcucagcgcgcaguggcagaagggggaggagguccaggugaucgccguggagcccggcaagaaccccaagaacuuccagaccaugcccggcacguuccagaccaccaccggggagaucggcgccaucgcccuggacuucaagcccgggacgagcggcucccccaucaucaaccgcgagggcaaggucguggggcuguacggcaacgggguggucaccaagaacggcggguacgugagcggcaucgcccagaccaacgcggagccggacggccccacccccgagcuggaggaggagauguucaagaagcggaaccucacgaucauggaccugcaccccggguccggcaagacccgcaaguaccugccggccaucgugcgggaggccaucaagcgccggcuccgcacccugauccuggcccccacccgggucguggccgcggagauggaggaggcccucaaggggcugcccauccgcuaccagacgaccgccaccaagagcgagcacaccggccgggagaucguggaccugaugugccacgccacguucaccaugcgccuccugucccccguccgggugccgaacuacaaccugaucaucauggacgaggcccacuucaccgaccccgcgagcaucgccgcccgcggguacaucuccacccgggugggcaugggcgaggccgcggccaucuucaugacggccacgccgcccgggaccgccgacgccuucccgcagagcaacgcgcccauccaggacgaggagcgcgacauccccgagcgcuccuggaacagcggcaacgaguggaucaccgacuucgccgggaagacggucugguucgugcccuccaucaaggccggcaacgacaucgccaacugccuccggaagaacgggaagaaggugauccagcugagccgcaagaccuucgacaccgaguaccagaagaccaagcugaacgacugggacuucgucgugacgaccgacaucuccgagaugggcgccaacuucaaggcggaccgggugaucgacccgcgccggugccucaagcccgucauccugaccgacggccccgagcgcgugauccuggccgggcccaugccggugaccgccgccagcgccgcgcagcggcgcggccgggucgggcgcaacccccagaaggagaacgaccaguacaucuucacgggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagagccggaagaccuucguggagcugaugcgccgcggggaccuccccguguggcuggcccacaaggucgccuccgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacagcgacccgcuggcgcucaaggaguucaaggaguucgccgccggccgcaaguccaucgcccuggaccuggucaccgagaucgggcgggugcccagccaccucgcccaccgcacccggaacgcgcuggacaaccuggugaugcuccacacgagcgagcacggcgggcgcgccuaccggcacgccgucgaggagcugcccgagaccauggagacccugcuccugcugggccucaugauccugcugaccgggggcgccaugcuguuccugaucuccggcaaggggaucggcaagacgagcaucgggcugaucugcgugaucgccuccagcggcaugcucuggauggcggagaucccgcugcaguggaucgccuccgccaucgugcuggaguucuucaugaugguccuccugauccccgagcccgagaagcagcgcacgccccaggacaaccagcuggccuacguggugaucgggauccucacccuggccgcgaucaucgccgccaacgagaugggccugcucgagaccacgaagcgggaccugggcaugagcaaggagccgggggucgugucccccaccagcuaccuggacguggaccuccaccccgccuccgcguggacccuguacgccgucgccaccacggugaucacccccaugcugcgccacaccaucgagaacagcaccgccaacgugucccucgccgcgaucgccaaccaggccgucgugcugaugggccuggacaagggguggccgaucagcaagauggaccucggcgugccccugcuggcccucgggugcuacucccaggucaacccccugacgcugaccgccgcggugcuccugcugaucacccacuacgccaucaucggccccggccuccaggccaaggccacccgggaggcccagaagcgcacggcggccgggaucaugaagaacccgaccguggacggcaucaugaccaucgaccuggaccccgucaucuacgacagcaaguucgagaagcagcugggccaggugaugcuccuggugcugugcgccguccagcuccugcugaugcggaccuccugggcccucugcgaggcgcugacgcuggccaccggccccaucaccacccucugggagggcagccccgggaaguucuggaacacgaccaucgccguguccauggccaacaucuuccgcggcagcuaccuggccggggcgggccuggccuucuccaucaugaaguccguggggaccggcaagcggggcaccgggagccagggcgagacgcucggggagaaguggaagaagaagcugaaccagcugucccgcaaggacuucgaccucuacaagaaguccggcaucaccgaggucgaccggaccgaggccaaggaggggcugaagcgcggcgagaucacccaccacgccgugucccggggcagcgccaagcugcagugguucguggagcgcaacauggucaucccggaggggcgggugaucgaccucggcugcgggcgcggcgggugguccuacuacugcgcgggccugaagaaggugaccgagguccggggcuacacgaagggcgggcccgggcacgaggagcccgugcccaugagcaccuacggcuggaacaucgugaagcugauguccgggaaggacgucuucuaccucccgcccgagaagugcgacacccugcugugcgacaucggcgagagcucccccagccccaccguggaggagucccgcacgauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugagccgcaacuccacccacgagauguacuggaucagcaacggcaccgggaacaucguggccuccgugaacauggucagccggcuccugcugaaccgcuucacgaugacccaccggcgcccgaccaucgagaaggacguggaccucggcgccggcacccggcacgugaacgccgagcccgagacgcccaacauggacgucaucggggagcgcaucaagcggaucaaggaggagcacaacuccaccuggcacuacgacgacgagaacccguacaagaccugggccuaccacggcagcuacgaggugaaggcgaccggguccgccagcagcaugaucaacggcguggucaagcugcugacgaagcccugggacgugguccccauggugacccagauggccaugaccgacaccacgcccuucgggcagcagcgcguguucaaggagaaggucgacacccggaccccgcgcuccaugcccggcacccggcgcgugaugggcaucacggccgaguggcucuggcggacccuggggcgcaacaagaagccccggcugugcacccgcgaggaguucaccaagaaggugcgcacgaacgcggccaugggcgccgucuucaccgaggagaaccagugggacagcgccaaggccgcgguggaggacgaggacuucuggaagcucguggaccgggagcgcgagcugcacaagcuggggaagugcggcuccugcgucuacaacaugauggggaagcgggagaagaagcucggcgaguucggcaaggccaaggggagccgcgccaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgcgauguacgccgacgacaccgccgggugggacacccgcaucacggaggacgaccugcacaacgaggagaagaucacccagcagauggacccggagcaccggcagcucgccaacgccaucuucaagcugaccuaccagaacaagguggucaaggugcagcgccccacccccacgggcaccgugauggacaucaucucccggaaggaccagcgcggcagcgggcaggucggcaccuacgggcugaacaccuucaccaacauggaggcgcagcucauccggcagauggagggcgagggggugcuguccaaggccgaccuggagaacccccaccucccggagaagaagaucacgcaguggcuggagaccaagggcguggagcgccugaagcggauggccaucagcggcgacgacugcgucgugaagcccaucgacgaccgcuucgccaacgcccuccuggcgcugaacgacauggggaaggugcggaaggacaucccccaguggcagcccuccaagggcuggcacgacuggcagcaggucccguucugcagccaccacuuccacgagcucaucaugaaggacgggcgcaagcugguggugcccugccggccccaggacgagcugaucggccgcgcccggaucucccagggggccggcuggagccucaaggagaccgccugccugggcaaggcguacgcccagauguggucccugauguacuuccaccgccgcgaccuccggcuggccagcaacgccaucugcuccgccguccccgugcacugggugccgaccagccgcacgaccuggagcauccacgcgcaccaccaguggaugaccaccgaggacaugcugacggucuggaaccggguguggaucgaggacaaccccuggauggaggacaagacccccgugaccaccugggagaacguccccuaccucgggaagcgcgaggaccaguggugcggcucccugaucgggcugacgagccgggccaccugggcccagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10050 - RNA, 9873 nt, Artificial Sequence
  derived and/or modified CDS sequence (opt1) from DENV-3__JF920408__SS-prME
accagccucugccucaugaugauccugcccgccgcccuggcguuccaccucaccagccgggacggggagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgggacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgggacccagggcgugacggccgagaucacgccccaggccagcaccaccgaggcgauccugcccgaguacgggacccugggccucgagugcuccccgcgcacgggccuggacuucaacgagaugauccugcucaccaugaagaacaaggccuggaugguccaccggcagugguucuucgaccugccccugcccuggaccagcggggccaccacggagacccccaccuggaaccgcaaggagcuccuggugaccuucaagaacgcccacgccaagaagcaggagguggucgugcugggcucccaggagggggcgaugcacacggcccucaccggcgccaccgagauccagaacagcgggggcaccggcaucuucgccgggcaccugaagugccggcugaagauggacaagcucgagcugaagggcauguccuacgccaugugcacgaacaccuucgugcugaagaaggaggucagcgagacccagcacgggaccauccucaucaagguggaguacaagggcgaggacgugccgugcaagauccccuucuccacggaggacggccaggggaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcagcuccaucggcaagauguucgaggcgaccgcccgcggggcccgccggauggccauccugggcgacacggccugggacuucgggagcgugggcggggugcucaacucccugggcaagaugguccaccagaucuucggcagcgcguacaccgcccuguucuccggggugagcugggugaugaagaucggcaucgggguccuccugaccuggaucggccugaacuccaagaacaccagcauguccuucagcugcaucgccaucgggaucaucacgcucuaccugggcgccguggugcaggccgacaugggcugcgucaucaacuggaaggggaaggagcugaagugcggcuccgggaucuucgugaccaacgaggugcacaccuggaccgagcaguacaaguuccaggcggacagccccaagcgccucgccacggccaucgccggcgccugggagaacggggucugcggcauccgcuccaccacccggauggagaaccugcuguggaagcagaucgcgaacgagcucaacuacauccugugggagaacaacaucaagcugaccgugguggucggcgacaucaucggggugcucgagcagggcaagcgcacgcugacgccccagccgauggagcugaaguacagcuggaagaccugggggaaggccaagaucgugaccgccgagacgcagaacuccagcuucaucaucgacggccccaacacccccgagugccccuccgucagccgggccuggaacgugugggagguggaggacuacggcuucggggucuucaccaccaacaucuggcucaagcugcgcgagguguacacccagcugugcgaccaccggcucauguccgcggccgugaaggacgagcgcgccguccacgccgacaugggcuacuggaucgagagccagaagaacgggagcuggaagcuggagaaggccucccugaucgaggugaagacgugcaccuggcccaagagccacacccucugguccaacggcgugcuggagagcgacaugaucauccccaagucccuggcggggcccaucagccagcacaaccaccggccgggcuaccacacccagacggccggccccuggcaccucgggaagcuggagcuggacuucaacuacugcgagggcaccaccgucgugaucaccgagaacugcgggacgcgcggccccucccuccggaccaccaccgugagcgggaagcugauccacgaguggugcugccgcuccugcacgcugcccccgcuccgguacaugggcgaggacggcugcugguacgggauggagauccgccccaucagcgagaaggaggagaacauggucaagucccuggugagcgccggcuccgggaagguggacaacuucaccaugggcguccugugccucgccauccuguucgaggaggugaugcgggggaaguucggcaagaagcacaugaucgccggcguguucuucaccuucguccugcuccugagcgggcagaucaccuggcgcgacauggcgcacacgcugaucaugaucggcuccaacgccagcgaccggauggggaugggcgugaccuaccucgcccugaucgccaccuucaagauccagcccuuccuggcccucggcuucuuccugcgcaagcugaccucccgggagaaccuccugcugggggugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcagcaacaccaucuucacccugacggucgccuggcgcaccgccacccugauccucgccggggugucccugcugccggucugccagagcuccagcaugcggaagaccgacuggcuccccauggcgguggccgccaugggcgugccgccccucccgcuguucaucuucggccucaaggacacgcugaagcgccgcuccuggccccugaacgagggggucauggccgugggccucgugagcauccuggccuccagccugcuccggaacgacguccccauggcggggccccugguggccggcgggcugcucaucgccugcuacgugaucaccggcaccuccgccgaccugaccgucgagaaggccgcggacaucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccgggguccugugggacgugcccagcccgcccgagacccagaaggccgagcuggaggagggcguguaccgcaucaagcagcaggggaucuucggcaagacccaggucggcgugggggugcagaaggagggcgucuuccacaccauguggcacgugacgcgcggggcggugcucaccuacaacggcaagcgccuggagcccaacugggccuccgucaagaaggaccugaucagcuacgggggcggcuggcggcucuccgcccaguggcagaagggggaggagguccaggugaucgccgucgagcccggcaagaaccccaagaacuuccagaccaugcccgggaccuuccagacgaccaccggcgagaucggcgcgaucgcccuggacuucaagcccgggaccagcggcucccccaucaucaaccgcgaggggaagguggugggccuguacgggaacggcgucgugacgaagaacggcggguacgugagcggcaucgcccagaccaacgccgagccggacgggcccacccccgagcuggaggaggagauguucaagaagcggaaccucaccaucauggaccugcaccccggcagcgggaagacgcgcaaguaccugccggccaucguccgggaggcgaucaagcgccggcuccgcacccugauccuggcccccacccgggugguggccgccgagauggaggaggcccucaagggccugcccauccgcuaccagaccacggcgaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggguacaucagcacccgggucggcaugggggaggccgccgccaucuucaugaccgcgacgccgcccggcaccgccgacgccuucccgcaguccaacgcccccauccaggacgaggagcgcgacauccccgagcgcagcuggaacuccgggaacgaguggaucaccgacuucgccggcaagaccgugugguucgugcccagcaucaaggcgggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacgggcccgagcgcgugauccuggccggccccaugccggucaccgcggccuccgccgcccagcggcgcgggcgggugggccgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggggagucccggaagaccuucguggagcugaugcgccggggcgaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggaguucgccgcggggcgcaagagcaucgcccuggaccuggugaccgagaucggccgggugcccucccaccucgcccaccgcacccggaacgcccuggacaaccuggucaugcuccacaccagcgagcacgggggccgcgccuaccggcacgcgguggaggagcugcccgagacgauggagacccugcuccugcugggccucaugauccugcugaccgggggcgccaugcuguuccugaucuccgggaagggcaucgggaagaccagcaucggccugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagaccaccaagcgggaccuggggauguccaaggagccgggcguggugagccccacguccuaccuggacgucgaccuccaccccgccagcgccuggacccuguacgccguggcgaccaccgugaucacgcccaugcugcgccacaccaucgagaacuccaccgccaacgucagccucgccgccaucgccaaccaggcgguggugcugauggggcuggacaagggcuggccgaucuccaagauggaccucggcgucccccugcuggcccucgggugcuacagccaggugaacccccugacccugacggccgccgugcuccugcugaucacccacuacgccaucaucggccccgggcuccaggcgaaggccacccgggaggcccagaagcgcaccgccgccggcaucaugaagaacccgacggucgacggcaucaugaccaucgaccuggaccccgugaucuacgacuccaaguucgagaagcagcugggccaggugaugcuccugguccugugcgcggugcagcuccugcugaugcggaccagcugggcccucugcgaggcccugacccuggccacgggccccaucaccacccucugggaggggucccccggcaaguucuggaacaccacgaucgcggugagcauggccaacaucuuccgcggguccuaccuggccggcgccggccuggccuucagcaucaugaaguccgucgggaccggcaagcgggggaccggcagccagggggagacccucggcgagaaguggaagaagaagcugaaccagcugucccgcaaggacuucgaccucuacaagaaguccggcaucaccgagguggaccggacggaggcgaaggaggggcugaagcgcggcgagaucacccaccacgccgugagccggggguccgccaagcugcagugguucgucgagcgcaacauggugaucccggagggccgggugaucgaccucgggugcggccgcggcggguggagcuacuacugcgccggccugaagaaggucaccgaggugcggggguacaccaagggcgggcccggccacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccgcaccauccgcguccugaagaugguggagccguggcucaagaacaaccaguucugcaucaaggugcugaaccccuacaugcccacggucaucgagcaccuggagcggcuccagcgcaagcacgggggcaugcuggugcggaacccccugucccgcaacagcacccacgagauguacuggaucuccaacggcaccgggaacaucguggccagcgucaacauggugucccggcuccugcugaaccgcuucaccaugacgcaccggcgcccgaccaucgagaaggacguggaccucggcgcggggacccggcacgucaacgccgagcccgagacccccaacauggaggugaucggcgagcgcaucaagcggaucaaggaggagcacaacagcacguggcacuacgacgacgagaacccguacaagaccugggccuaccacggguccuacgaggugaaggccaccggcagcgccuccagcaugaucaacggcgucgugaagcugcugaccaagcccugggacgucgugcccauggugacgcagauggcgaugaccgacaccacccccuucgggcagcagcgcgucuucaaggagaagguggacacgcggaccccgcgcuccaugcccggcacccggcgcgugauggggaucaccgccgaguggcucuggcggacgcugggccgcaacaagaagccccggcugugcacccgcgaggaguucaccaagaagguccgcaccaacgccgccaugggggcgguguucacggaggagaaccagugggacagcgccaaggccgccguggaggacgaggacuucuggaagcucgucgaccgggagcgcgagcugcacaagcugggcaagugcggcagcugcguguacaacaugauggggaagcgggagaagaagcucggcgaguucgggaaggccaagggcucccgcgcgaucugguacauguggcugggggcccgguaccuggaguucgaggcccucggcuuccugaacgaggaccacugguucagccgcgagaacuccuacagcggcguggagggggagggccugcacaagcucggguacauccugcgggacaucuccaagauccccggcggcgccauguacgccgacgacaccgcggggugggacacccgcaucaccgaggacgaccugcacaacgaggagaagaucacgcagcagauggacccggagcaccggcagcucgccgacgccaucuucaagcugaccuaccagaacaaggucgugaaggugcagcgccccacccccaccggcaccgucauggacaucaucagccggaaggaccagcgcggguccggccagguggggacguacggccugaacaccuucaccaacauggaggcccagcucauccggcagauggagggcgagggggugcugagcaaggccgaccuggagaacccccaccucccggagaagaagaucacccaguggcuggagacgaagggcgucgagcgccugaagcggauggcgaucuccggggacgacugcguggugaagcccaucgacgaccgcuucgccaacgcccuccuggcccugaacgacaugggcaagguccggaaggacaucccccaguggcagcccagcaagggguggcacgacuggcagcaggucccguucugcucccaccacuuccacgagcucaucaugaaggacggccgcaagcuggugguccccugccggccccaggacgagcugaucggccgcgcccggaucagccagggggcgggcuggucccucaaggagaccgccugccuggggaaggccuacgcccagauguggagccugauguacuuccaccgccgcgaccuccggcuggcguccaacgccaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucggcaagcgcgaggaccaguggugcgggucccugaucggccugaccagccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10051 - RNA, 9873 nt, Artificial Sequence
  derived and/or modified CDS sequence (opt1) from DENV-3__JF920397__SS-prME
accagccugugccucaugaugauccugcccgcggcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggaccuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaucuaccagcuguggaccgcccugaucagccucacgugcuccaacaccaucuucacccugaccgucgccuggcgcacggccacccugauccucgccggggugagccugcugccgaugugccaguccagcuccaugcggaagaccgacuggcuccccauggcggucgccgccaugggcgugccgccccucccgcuguucaucuucagccucaaggacacccugaagcgccgcuccuggccccugaacgagggggugauggccgucggccucgugagcauccuggccuccagccugcuccggaacgacgugcccauggcgggcccccuggucgccgggggccugcucaucgccugcuacgugaucacggggaccuccgccgaccugaccguggagaaggccgcggacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcaucuucccguacagcauccccgccacccugcucguguggcacaccuggcagaagcagacccagcgguccggcgugcugugggacguccccagcccgcccgagacgcagaaggccgagcuggaggaggggguguaccgcaucaagcagcagggcaucuucgggaagacccaggugggcgucggggugcagaaggagggcguguuccacaccauguggcacgucacccggggcgcggugcucacguacaacgggaagcgccuggagcccaacugggccuccgugaagaaggaccugaucagcuacggcgggggcuggcggcucuccacccaguggcagaagggggaggagguccaggugaucgccguggagcccggcaagaaccccaagaacuuccagaccaugcccggcaccuuccagacgaccaccggggagaucggcgccaucgcgcuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggccaucaagcgccggcuccgcacccugauccuggcgcccacccgggucguggccgccgagauggaggaggcccucaaggggcugcccauccgcuaccagaccacggccaccaaguccgagcacaccggccgggagaucguggaccugaugugccacgcgaccuucacgaugcgccuccugagccccguccgggugccgaacuacaaccugaucaucauggacgaggcccacuucaccgaccccgccuccaucgccgcccgcggguacaucagcacccgggugggcaugggcgaggcggccgccaucuucaugaccgccacgccgcccgggaccgcggacgccuucccgcaguccaacgcccccauccaggacgaggagcgcgacauccccgagcgcagcuggaacuccggcaacgaguggaucaccgacuucgccgggaagaccgucugguucgugcccagcaucaaggccggcaacgacaucgcgaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgccgcguccgccgcccagcggcgcggccgggucgggcgcaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccguguggcuggcccacaaggucgcgagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggaguucgccgccggccgcaagagcaucgcgcuggaccuggucaccgagaucgggcgggugcccucccaccucgcccaccgcacccggaacgcccuggacaaccuggugaugcuccacaccagcgagcacggcgggcgcgccuaccggcacgccgucgaggagcugcccgagacgauggagacccugcuccugcugggccucaugauccugcugaccgggggcgcgaugcuguuccugaucagcggcaaggggaucggcaagaccuccaucgggcugaucugcgugaucgccagcuccggcaugcucuggauggccgagaucccgcugcaguggaucgccagcgccaucgugcuggaguucuucaugaugguccuccugauccccgagcccgagaagcagcgcacgccccaggacaaccagcuggcguacguggugaucgggauccucacccuggccgccaucaucgccgccaacgagaugggccugcucgagaccaccaagcgggaccugggcauguccaaggagccgggggucgugagccccacguccuaccuggacguggaccuccaccccgcgagcgccuggacccuguacgccgucgccaccaccgugaucacgcccaugcugcgccacaccaucgagaacuccaccgcgaacgugagccucgccgccaucgccaaccaggccgucgugcugaugggccuggacaagggguggccgaucuccaagauggaccucggcgugccccugcuggcgcucgggugcuacagccaggucaacccccugacccugacggccgccgugcuccugcugaucacccacuacgccaucaucggccccggccuccaggccaaggcgacccgggaggcccagaagcgcaccgccgccgggaucaugaagaacccgacgguggacggcaucaugaccaucgaccuggaccccgucaucuacgacuccaaguucgagaagcagcugggccaggugaugcuccuggugcugugcgucgugcagcuccugcugaugcggaccagcugggcccucugcgaggcgcugacccuggccacgggccccaucaccacccucugggagggcucccccgggaaguucuggaacaccacgaucgccgugagcauggccaacaucuuccgcggcuccuaccuggcgggggccggccuggccuucagcaucaugaaguccgucgggaccggcaagcggggcaccgggagccagggcgagacccucggggagaaguggaagaagaagcugaaccagcugagccgcaaggacuucgaccucuacaagaaguccggcaucaccgagguggaccggacggaggccaaggaggggcugaagcgcggcgagaucacccaccacgccgugagccggggcuccgcgaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccgcaccauccgcguccugaagaugguggagccguggcucaagaacaaccaguucugcaucaaggugcugaaccccuacaugcccacggucaucgagcaccuggagcggcuccagcgcaagcacggcgggaugcuggugcggaacccccugucccgcaacagcacccacgagauguacuggaucuccaacggcaccgggaacaucguggccagcgucaacauggugucccggcuccugcugaaccgcuucaccaugacgcaccggcgcccgaccaucgagaaggacguggaccucggcgccggcacccggcacgucaacgccgagcccgagacccccaacauggacgugaucggggagcgcaucaagcggaucaaggaggagcacaacagcacguggcacuacgacgacgagaacccguacaagaccugggcguaccacggcuccuacgaggugaaggccaccgggagcgccuccagcaugaucaacggcgucgugaagcugcugaccaagcccugggacgucgugcccauggugacgcagauggccaugaccgacaccacccccuucgggcagcagcgcgucuucaaggagaagguggacacgcggaccccgcgcagcaugcccggcacccggcgcgugaugggcaucaccgccgaguggcucuggcggacgcuggggcgcaacaagaagccccggcugugcacccgcgaggaguucaccaagaagguccgcaccaacgcggccaugggcgccguguucacggaggagaaccagugggacuccgccaaggcggccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgccaucugguacauguggcugggcgcccgguaccuggaguucgaggcgcucggguuccugaacgaggaccacugguucagccgcgagaacuccuacagcggcguggagggggagggccugcacaagcucggcuacauccugcgggacaucuccaagauccccgggggcgccauguacgccgacgacaccgccgggugggacacccgcaucaccgaggacgaccugcacaacgaggagaagaucacgcagcagauggacccggagcaccggcagcucgccaacgcgaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcccagcucauccggcagauggagggcgagggggugcugagcaaggccgaccuggagaacccccaccucccggagaagaagaucacccaguggcuggagacgaagggcgucgagcgccugaagcggauggccaucuccggcgacgacugcguggugaagcccaucgacgaccgcuucgccaacgcgcuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggccggcuggucccucaaggagaccgccugccugggcaaggcguacgcccagauguggagccugauguacuuccaccgccgcgaccuccggcuggccuccaacgccaucugcagcgcggugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucgggaagcgcgaggaccaguggugcggcagccugaucgggcugaccucccgggccacgugggcccagaacaucccgaccgccauccagcagguccgcagccucaucggcaacgaggaguuccuggacuacaugcccuccaugaagcgguuccgcaaggaggaggagagcgagggggcgaucugguga

SEQ ID NO: 10052 - RNA, 9873 nt, Artificial Sequence
  derived and/or modified CDS sequence (opt1) from DENV-3__JN093513__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacaccuccgaccggauggggaugggcgugaccuaccucgcccugaucgccaccuucaagauccagcccuuccuggcccucggguucuuccugcgcaagcugacgagccgggagaaccuccugcugggcgugggccucgccauggcgaccacccugcagcugcccgaggacaucgagcagauggccaacgggaucgcccucggccugauggcccugaagcucaucacccaguucgagaucuaccagcuguggacggcgcugaucagccugaccugcuccaacaccaucuucacccugacggucgccuggcgcaccgccacccugauccucgccggggugagccugcugccggucugccaguccagcuccaugcggaagaccgacuggcuccccauggccguggcggccaugggcgugccgccccucccgcuguucaucuucgggcucaaggacacgcugaagcgccgcagcuggccccugaacgagggcgucauggccgugggccucguguccauccuggccagcucccugcuccggaacgacguccccauggccgggccccugguggcgggcgggcugcucaucgccugcuacgugaucaccggcaccagcgccgaccugaccgucgagaaggccgccgacaucacgugggaggaggaggcggagcagaccggggugucccacaaccugaugaucaccguggacgacgacggcaccaugcgcaucaaggacgacgagaccgagaacauccucacgguccugcugaagaccgcccuccugaucgugagcggcaucuucccguacuccauccccgccacccugcucguguggcacaccuggcagaagcagacgcagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacaccauguggcacgugacgcgcggggcggugcucaccuacaacggcaagcgccuggagcccaacugggcgagcgucaagaaggaccugaucuccuacgggggcggguggcggcucagcgcccaguggcagaagggcgaggagguccaggugaucgccgucgagcccggcaagaaccccaagaacuuccagaccaugcccgggaccuuccagacgaccaccggcgagaucggggccaucgcgcuggacuucaagcccggcaccuccggcagccccaucaucaaccgcgaggggaagguggugggccuguacgggaacggcgucgugacgaagaacgggggcuacgugagcggcaucgcccagaccaacgccgagccggacgggcccacccccgagcuggaggaggagauguucaagaagcggaaccucaccaucauggaccugcaccccggcuccgggaagacgcgcaaguaccugccggccaucguccgggaggccaucaagcgccggcuccgcacccugauccuggcgcccacccgggugguggccgccgagauggaggaggcccucaagggccugcccauccgcuaccagaccacggccaccaagagcgagcacaccgggcgggagaucgucgaccugaugugccacgcgaccuucacgaugcgccuccugucccccgugcgggugccgaacuacaaccugaucaucauggacgaggcccacuucaccgaccccgccagcaucgccgcccgcggcuacaucuccacccgggucggcaugggggaggcggccgccaucuucaugaccgccacgccgcccggcaccgcggacgccuucccgcagagcaacgcccccauccaggacgaggagcgcgacauccccgagcgcuccuggaacagcgggaacgaguggaucaccgacuucgccggcaagaccgugugguucgugcccuccaucaaggccgggaacgacaucgcgaacugccuccggaagaacggcaagaaggucauccagcugagccgcaagacguucgacaccgaguaccagaagaccaagcugaacgacugggacuucguggugaccacggacaucuccgagaugggcgccaacuucaaggccgaccgggucaucgacccgcgccggugccucaagcccgugauccugaccgacgggcccgagcgcgugauccuggccggccccaugccggucaccgccgcgagcgccgcccagcggcgcgggcgggugggccgcaacccccagaaggagaacgaccaguacaucuucaccgggcagccccucaacaacgacgaggaccacgcccacuggaccgaggccaagaugcugcuggacaacaucaacacgcccgagggcaucaucccggcccucuucgagcccgagcgggagaaguccgccgccaucgacggcgaguaccgccugaagggggagagccggaagaccuucguggagcugaugcgccggggcgaccuccccgucuggcuggcccacaagguggcguccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcacguacagcgacccgcuggcccucaaggaguucaaggaguucgccgccgggcgcaaguccaucgcgcuggaccuggugaccgagaucggccgggugcccagccaccucgcccaccgcacccggaacgcccuggacaaccuggucaugcuccacaccuccgagcacgggggccgcgccuaccggcacgccguggaggagcugcccgagacgauggagacccugcuccugcuggggcucaugauccugcugaccggcggcgcgaugcuguuccugaucagcgggaagggcaucgggaagaccagcaucggccugaucugcgugaucgccuccagcgggaugcucuggauggccgagaucccgcugcaguggaucgccuccgccaucguccuggaguucuucaugauggugcuccugauccccgagcccgagaagcagcgcacgccccaggacaaccagcuggcguacguggucaucggcauccucacccuggccgccaucaucgccgccaacgagaugggccugcucgagaccaccaagcgggaccuggggaugagcaaggagccgggcguggugucccccacgagcuaccuggacgucgaccuccaccccgcguccgccuggacccuguacgccguggccaccaccgugaucacgcccaugcugcgccacaccaucgagaacagcaccgcgaacgucucccucgccgccaucgccaaccaggccguggugcugauggggcuggacaagggcuggccgaucagcaagauggaccucggggucccccugcuggcgcucggcugcuacucccaggugaacccccugacccugacggccgccgugcuccugcugaucacccacuacgccaucaucggccccgggcuccaggccaaggcgacccgggaggcccagaagcgcaccgccgccggcaucaugaagaacccgacggucgacgggaucaugaccaucgaccuggaccccgugaucuacgacagcaaguucgagaagcagcugggccaggugaugcuccugguccugugcgccgugcagcuccugcugaugcggaccuccugggcgcucugcgaggcccugacccuggccacgggccccaucaccacccucugggaggggagccccggcaaguucuggaacaccacgaucgccguguccauggcgaacaucuuccgcgggagcuaccuggccggcgccgggcuggccuucuccaucaugaaguccgucggcaccggcaagcgggggaccggcucccagggggagacccucggcgagaaguggaagaagaagcugaaccagcugagccgcaaggacuucgaccucuacaagaaguccgggaucaccgagguggaccggacggaggccaaggagggccugaagcgcggcgagaucacccaccacgcggugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacaccaagggcgggcccggccacgaggagcccgugcccaugagcacguacggguggaacaucgucaagcugauguccggcaaggacguguucuaccucccgcccgagaagugcgacacccugcugugcgacaucggcgagagcucccccagccccaccguggaggagucccgcaccauccgcguccugaagaugguggagccguggcucaagaacaaccaguucugcaucaaggugcugaaccccuacaugcccacggucaucgagcaccuggagcggcuccagcgcaagcacgggggcaugcuggugcggaacccccugagccgcaacuccacccacgagauguacuggaucagcaacgggaccggcaacaucguggccuccgucaacauggugagccggcuccugcugaaccgcuucaccaugacgcaccggcgcccgaccaucgagaaggacguggaccucggcgccgggacccggcacgucaacgcggagcccgagacccccaacauggacgugaucggcgagcgcaucaagcggaucaaggaggagcacaacuccacguggcacuacgacgacgagaacccguacaagaccugggccuaccacgggagcuacgaggugaaggccaccggcuccgccagcuccaugaucaacggggucgugaagcugcugaccaagcccugggacgucgugcccauggugacgcagauggccaugaccgacaccacccccuucggccagcagcgcgucuucaaggagaagguggacacgcggaccccgcgcagcaugcccggcacccggcgcgugauggggaucaccgcggaguggcucuggcggacgcugggccgcaacaagaagccccggcugugcacccgcgaggaguucaccaagaagguccgcaccaacgccgccaugggggccguguucacggaggagaaccagugggacagcgcgaaggccgccguggaggacgaggacuucuggaagcucgucgaccgggagcgcgagcugcacaagcugggcaagugcggguccugcguguacaacaugaugggcaagcgggagaagaagcucggcgaguucgggaaggccaagggcagccgcgccaucugguacauguggcugggggcgcgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgccgacgacaccgccggcugggacacccgcaucaccgaggacgaccugcacaacgaggagaagaucacgcagcagauggacccggagcaccggcagcucgcgaacgccaucuucaagcugaccuaccagaacaaggucgugaaggugcagcgccccacccccaccggcaccgucauggacaucaucucccggaaggaccagcgcgggagcggccagguggggacguacggccugaacaccuucaccaacauggaggcccagcucauccggcagauggagggggagggcgugcuguccaaggccgaccuggagaacccccaccucccggagaagaagaucacccaguggcuggagacgaagggcgucgagcgccugaagcggauggccaucagcggggacgacugcguggugaagcccaucgacgaccgcuucgcgaacgcccuccuggcccugaacgacaugggcaagguccggaaggacaucccccaguggcagcccuccaagggguggcacgacuggcagcaggucccguucugcagccaccacuuccacgagcucaucaugaaggacggccgcaagcuggugguccccugccggccccaggacgagcugaucgggcgcgcccggaucucccagggcgccggcuggagccucaaggagaccgcgugccuggggaaggccuacgcccagauguggucccugauguacuuccaccgccgcgaccuccggcuggccagcaacgcgaucugcuccgccgugcccgugcacugggucccgaccagccgcaccacgugguccauccacgcccaccaccaguggaugaccaccgaggacaugcugaccguguggaaccggguguggaucgaggacaaccccuggauggaggacaagacgcccgucaccaccugggagaacgugcccuaccucggcaagcgcgaggaccaguggugcgggagccugaucggccugaccagccgggccacgugggcccagaacaucccgaccgcgauccagcagguccgcucccucaucgggaacgaggaguuccuggacuacaugcccagcaugaagcgguuccgcaaggaggaggaguccgagggcgccaucugguga

SEQ ID NO: 10053 - RNA, 9873 nt, Artificial Sequence
  derived and/or modified CDS sequence (opt1) from DENV-3__JF937624__SS-prME
accagccucugccucaugaugauccugcccgccgcccuggcguuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucgggcucaaggacacgcugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugaccgucgagaaggccgcggacaucacgugggaggaggaggccgagcagaccggggugucccacaaccugaugaucaccguggacgacgacggcaccaugcgcaucaaggacgacgagaccgagaacauccucacgguccugcugaagaccgcccuccugaucgugagcggcaucuucccguacuccauccccgccacccugcucguguggcacaccuggcagaagcagacgcagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacaccauguggcacgugacgcgcggggcggugcucaccuacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggaccuuccagacgaucaccggcgagaucggggcgaucgcccuggacuucaagcccggcaccuccggcagccccaucaucaaccgcgaggggaagguggugggccuguacgggaacggcgucgugaccaagaacgggggcuacgugagcggcaucgcccagacgaacgccgagccggacgggcccacccccgagcuggaggaggagauguucaagaagcggaaccucaccaucauggaccugcaccccggcuccgggaagacccgcaaguaccugccggccaucguccgggaggcgaucaagcgccggcuccgcacgcugauccuggcccccacccgggugguggccgccgagauggaggaggcccucaagggccugcccauccgcuaccagaccaccgcgaccaaguccgagcacaccgggcgggagaucgucgaccugaugugccacgccaccuucaccaugcgccuccugucccccgugcgggugccgaacuacaaccugaucaucauggacgaggcccacuucacggaccccgccagcaucgccgcgcgcggcuacaucuccacccgggucggcaugggggaggccgccgccaucuucaugaccgcgacgccgcccggcacggccgacgccuucccgcagagcaacgcccccauccaggacgaggagcgcgacauccccgagcgcuccuggaacagcgggaacgaguggaucaccgacuucgccggcaagaccgugugguucgugcccuccaucaaggcggggaacgacaucgccaacugccuccggaagaacggcaagaaggucauccagcugagccgcaagaccuucgacacggaguaccagaagaccaagcugaacgacugggacuucguggugaccaccgacaucuccgagaugggcgccaacuucaaggccgaccgggucaucgacccgcgccggugccucaagcccgugauccugacggacgggcccgagcgcgugauccuggccggccccaugccggucaccgcggccagcgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacccccgagggcaucaucccggcccucuucgagcccgagcgggagaaguccgccgccaucgacggcgaguaccgccugaagggggagagccggaagacguucguggagcugaugcgccggggcgaccuccccgucuggcuggcgcacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcaccuacagcgacccgcuggcccucaaggaguucaaggaguucgccgcggggcgcaaguccaucgcccuggaccuggugacggagaucggccgggugcccagccaccucgcccaccgcacccggaacgcccuggacaaccuggucaugcuccacaccuccgagcacgggggccgcgccuaccggcacgcgguggaggagcugcccgagaccauggagacgcugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgccuccgcgaucguccuggaguucuucaugauggugcuccugauccccgagcccgagaagcagcgcacgccccaggacaaccagcuggccuacguggucaucggcauccucacgcuggccgccaucaucgccgcgaacgagaugggccugcucgagaccaccaagcgggaccuggggaugagcaaggagccgggcguggugucccccaccagcuaccuggacgucgaccuccaccccgccuccgccuggacgcuguacgccguggcgaccaccgugaucacccccaugcugcgccacacgaucgagaacagcaccgccaacgucucccucgccgccaucgccaaccaggcgguggugcugauggggcuggacaagggcuggccgaucagcaagauggaccucggggucccccugcuggcccucggcugcuacucccaggugaacccccugacccugaccgccgccgugcuccugcugaucacgcacuacgccaucaucggccccgggcuccaggcgaaggccacccgggaggcccagaagcgcaccgccgccggcaucaugaagaacccgaccgucgacgggaucaugacgaucgaccuggaccccgugaucuacgacagcaaguucgagaagcagcugggccaggugaugcuccugguccugugcgcggugcagcuccugcugaugcggaccuccugggcccucugcgaggcccugacccuggccaccggccccaucacgacccucugggaggggagccccggcaaguucuggaacaccaccaucgcgguguccauggccaacaucuuccgcgggagcuaccuggccggcgccgggcuggccuucuccaucaugaaguccgucggcacgggcaagcgggggaccggcucccagggggagacccucggcgagaaguggaagaagaagcugaaccagcugagccgcaaggacuucgaccucuacaagaaguccgggaucaccgagguggaccggaccgaggcgaaggagggccugaagcgcggcgagaucacgcaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacaccaagggcgggcccggccacgaggagcccgugcccaugagcaccuacggguggaacaucgucaagcugauguccggcaaggacguguucuaccucccgcccgagaagugcgacacgcugcugugcgacaucggcgagagcucccccagccccaccguggaggagucccgcaccauccgcguccugaagaugguggagccguggcucaagaacaaccaguucugcaucaaggugcugaaccccuacaugcccaccgucaucgagcaccuggagcggcuccagcgcaagcacgggggcaugcuggugcggaacccccugagccgcaacuccacgcacgagauguacuggaucagcaacgggaccggcaacaucguggccuccgucaacauggugagccggcuccugcugaaccgcuucaccaugacccaccggcgcccgacgaucgagaaggacguggaccucggcgcggggacccggcacgucaacgccgagcccgagacccccaacauggacgugaucggcgagcgcaucaagcggaucaaggaggagcacaacuccaccuggcacuacgacgacgagaacccguacaagacgugggccuaccacgggagcuacgaggugaaggccaccggcuccgccagcuccaugaucaacggggucgugaagcugcugaccaagcccugggacgucgugcccauggugacccagauggcgaugacggacaccacccccuucggccagcagcgcgucuucaaggagaagguggacacccggacgccgcgcagcaugcccggcacccggcgcaucauggggaucaccgccgaguggcucuggcggacccugggccgcaacaagaagccccggcugugcacgcgcgaggaguucaccaagaaggugcgcaccaacgccgccaugggggcggucuucaccgaggagaaccagugggacagcgccaaggccgccguggaggacgaggacuucuggaagcucguggaccgggagcgcgagcugcacaagcugggcaagugcggguccugcgucuacaacaugaugggcaagcgggagaagaagcucggcgaguucgggaaggccaagggcagccgcgcgaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgccgacgacacggcgggcugggacacccgcaucaccgaggacgaccugcacaacgaggagaagaucacccagcagauggacccggagcaccggcagcucgccaacgccaucuucaagcugacguaccagaacaagguggucaaggugcagcgccccacccccaccggcaccgugauggacaucaucucccggaaggaccagcgcgggagcggccaggucgggaccuacggccugaacacguucaccaacauggaggcccagcucauccggcagauggagggggagggcgugcuguccaaggccgaccuggagaacccccaccucccggagaagaagaucacccaguggcuggagaccaagggcguggagcgccugaagcggauggcgaucagcggggacgacugcgucgugaagcccaucgacgaccgcuucgccaacgcccuccuggcccugaacgacaugggcaaggugcggaaggacaucccccaguggcagcccuccaagggguggcacgacuggcagcaggucccguucugcagccaccacuuccacgagcucaucaugaaggacggccgcaagcugguggugcccugccggccccaggacgagcugaucgggcgcgcccggaucucccagggcgcgggcuggagccucaaggagacggccugccuggggaaggccuacgcccagauguggucccugauguacuuccaccgccgcgaccuccggcuggcgagcaacgccaucugcuccgccguccccgugcacugggugccgaccagccgcaccaccugguccauccacgcccaccaccaguggaugacgaccgaggacaugcugaccgucuggaaccggguguggaucgaggacaaccccuggauggaggacaagacccccgugacgaccugggagaacguccccuaccucggcaagcgcgaggaccaguggugcgggagccugaucggccugaccagccgggccaccugggcgcagaacaucccgacggccauccagcagguccgcucccucaucgggaacgaggaguuccuggacuacaugcccagcaugaagcgguuccgcaaggaggaggaguccgagggcgccaucugguga

SEQ ID NO: 10054 - RNA, 9873 nt, Artificial Sequence
  derived and/or modified CDS sequence (opt1) from DENV-3__JN000938__SS-prME
accagccucugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccuucuccgagaaggaggagaacauggucaagagccugguguccgccggcgggggcaagguggacaacuucaccauggggguccugugccucgccauccuguucgaggaggugaugcggggcaaguucgggaagaagcacaugaucgccggcguguucuucaccuucguccugcuccugagcggccagaucaccuggcgcgacauggcgcacacgcugaucaugaucggguccaacgccagcgaccggaugggcaugggggugaccuaccucgcccugaucgccaccuucaagauccagcccuuccuggcccucggcuucuuccugcgcaagcugaccucccgggagaaccuccugcugggcguggggcucgcgauggccacgacccugcagcugcccgaggacaucgagcagauggccaacggcaucgcccucgggcugauggcgcugaagcucaucacccaguucgagaccuaccagcuguggacggcccugaucagccugaccugcagcaacaccaucuucacccugacggucgccuggcgcaccgccacccugauccucgccggcgugucccugcugccggucugccagagcuccagcaugcggaagaccgacuggcuccccauggcgguggccgccaugggggugccgccccucccgcuguucaucuucggccucaaggacacgcugaagcgccgcuccuggccccugaacgagggcgucauggccguggggcucgugagcauccuggccuccagccugcuccggaacgacguccccauggcgggcccccugguggccgggggccugcucaucgccugcuacgugaucaccgggaccuccgccgaccugaccgucgagaaggccgcggacaucacgugggaggaggaggccgagcagaccggcgugagccacaaccugaugaucaccguggacgacgacggcaccaugcgcaucaaggacgacgagaccgagaacauccucacgguccugcugaagaccgcccuccugaucguguccgggaucuucccguacagcauccccgccacccugcucguguggcacaccuggcagaagcagacgcagcgguccggcguccugugggacgugcccagcccgcccgagacccagaaggccgagcuggaggaggggguguaccgcaucaagcagcagggcaucuucgggaagacccaggucggcgugggcgugcagaaggagggggucuuccacaccauguggcacgugacgcggggcgcggugcucaccuacaacgggaagcgccuggagcccaacugggccuccgucaagaaggaccugaucagcuacggcgggggcuggcggcucuccgcccaguggcagaagggcgaggagguccaggugaucgccgucgagcccgggaagaaccccaagaacuuccagaccaugcccggcaccuuccagacgaccaccggggagaucggcgcgaucgcccuggacuucaagcccggcaccagcgggucccccaucaucaaccgcgagggcaaggugguggggcuguacggcaacggggucgugacgaagaacggcggcuacgugagcgggaucgcccagaccaacgccgagccggacggccccacccccgagcuggaggaggagauguucaagaagcggaaccucaccaucauggaccugcaccccgggagcggcaagacgcgcaaguaccugccggccaucguccgggaggcgaucaagcgccggcuccgcacccugauccuggcccccacccgggugguggccgccgagauggaggaggcccucaaggggcugcccauccgcuaccagaccacggcgaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggcuacaucagcacccgggucgggaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacggcaagaaggucauccagcugucccgcaagacguucgacaccgaguaccagaagaccaagcugaacgacugggacuucguggugaccacggacaucagcgagaugggggccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgagggcaucaucccggcccucuucgagcccgagcgggagaaguccgccgccaucgacggggaguaccgccugaagggcgagucccggaagaccuucguggagcugaugcgccgcggggaccuccccgucuggcuggcgcacaagguggccagcgagggcaucaaguacaccgaccgcaaguggugcuucgacggccagcggaacaaccagauccuggaggagaacauggacgucgagaucuggaccaaggagggggagaagaagaagcuccgcccccgguggcuggacgcccgcacguacuccgacccgcuggcccucaaggaguucaaggaguucgccgcgggccgcaagagcaucgcccuggaccuggugaccgagaucgggcgggugcccucccaccucgcccaccgcacccggaacgcccuggacaaccuggucaugcuccacaccagcgagcacggcgggcgcgccuaccggcacgcgguggaggagcugcccgagacgauggagacccugcuccugcugggccucaugauccugcugaccggcggggccaugcuguuccugaucuccggcaaggggaucggcaagaccagcaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucggcauccucacccuggccgccaucaucgccgcgaacgagauggggcugcucgagaccaccaagcgggaccugggcauguccaaggagccggggguggugagccccacguccuaccuggacgucgaccuccaccccgccagcgccuggacccuguacgccguggcgaccaccgugaucacgcccaugcugcgccacaccaucgagaacuccaccgccaacgucagccucgccgccaucgccaaccaggcgguggugcugaugggccuggacaagggguggccgaucuccaagauggaccucggcgucccccugcuggcccucggcugcuacagccaggugaacccccugacccugacggccgccgugcuccugcugaucacccacuacgccaucaucgggcccggccuccaggcgaaggccacccgggaggcccagaagcgcaccgccgccgggaucaugaagaacccgacggucgacggcaucaugaccaucgaccuggaccccgugaucuacgacuccaaguucgagaagcagcugggccaggugaugcuccugguccugugcgcggugcagcuccugcugaugcggaccagcugggcccucugcgaggcccugacccuggccacggggcccaucaccacccucugggagggcucccccgggaaguucuggaacaccacgaucgcggugagcauggccaacaucuuccgcggcuccuaccuggccggggccggccuggccuucagcaucaugaaguccgucggcaccgggaagcggggcaccgggagccagggcgagacccucggggagaaguggaagaagaagcugaaccagcugucccgcaaggacuucgaccucuacaagaaguccggcaucaccgagguggaccggacggaggcgaaggagggccugaagcgcggggagaucacccaccacgccgugagccggggcuccgccaagcugcagugguucgucgagcgcaacauggugaucccggaggggcgggugaucgaccucggcugcgggcgcggcggcuggagcuacuacugcgccgggcugaagaaggucaccgaggugcggggcuacaccaagggcgggcccgggcacgaggagcccgugcccauguccacguacggcuggaacaucgucaagcugaugagcggcaaggacguguucuaccucccgcccgagaagugcgacacccugcugugcgacaucggggaguccagccccucccccaccguggaggagagccgcaccauccgcguccugaagaugguggagccguggcucaagaacaaccaguucugcaucaaggugcugaaccccuacaugcccacggucaucgagcaccuggagcggcuccagcgcaagcacggcgggaugcuggugcggaacccccugucccgcaacagcacccacgagauguacuggaucuccaacggcaccggcaacaucguggccagcgucaacauggugucccggcuccugcugaaccgcuucaccaugacgcaccggcgcccgaccaucgagaaggacguggaccucggggcgggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgucgugcccauggugacgcagauggcgaugaccgacaccacccccuucggccagcagcgcgucuucaaggagaagguggacacgcggaccccgcgcuccaugcccgggacccggcgcgugaugggcaucaccgccgaguggcucuggcggacgcuggggcgcaacaagaagccccggcugugcacccgcgaggaguucaccaagaagguccgcaccaacgccgccaugggcgcgguguucacggaggagaaccagugggacagcgccaaggccgccguggaggacgaggacuucuggaagcucgucgaccgggagcgcgagcugcacaagcuggggaagugcggcagcugcguguacaacaugaugggcaagcgggagaagaagcucggggaguucggcaaggccaaggggucccgcgcgaucugguacauguggcugggcgcccgguaccuggaguucgaggcccucggguuccugaacgaggaccacugguucagccgcgagaacuccuacagcggcguggagggcgaggggcugcacaagcucggcuacauccugcgggacaucuccaagauccccgggggcgccauguacgccgacgacaccgcgggcugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccgggaccgucauggacaucaucagccggaaggaccagcgcggcuccggccaggugggcacguacgggcugaacaccuucaccaacauggaggcccagcucauccggcagauggagggcgagggcgugcugagcaaggccgaccuggagaacccccaccucccggagaagaagaucacccaguggcuggagacgaagggggucgagcgccugaagcggauggcgaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggcgcgggguggucccucaaggagaccgccugccugggcaaggccuacgcccagauguggagccugauguacuuccaccgccgcgaccuccggcuggcguccaacgccaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucgggaagcgcgaggaccaguggugcggcucccugaucgggcugaccagccgggccacgugggcgcagaacaucccgaccgccauccagcagguccgcagccucaucggcaacgaggaguuccuggacuacaugcccuccaugaagcgguuccgcaaggaggaggagagcgagggcgccaucugguga

SEQ ID NO: 10055 - RNA, 9873 nt, Artificial Sequence
  derived and/or modified CDS sequence (opt1) from DENV-3__JN093515__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagcgggaggagcccgugaacaucgaggccgagccgcccuucggggagagcaacaucgucaucggcaucggggacaacgcccugaagaucaacugguacaagaagggcuccagcaucgggaagauguucgaggcgaccgcccgcggcgcccggcgcauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccggagcaccacccgcauggagaaccugcuguggaagcagaucgcgaacgagcucaacuacauccugugggagaacaacaucaagcugaccgugguggucggggacaucaucggcgugcucgagcagggcaagcggacgcugacgccccagccgauggagcugaaguacuccuggaagaccugggggaaggccaagaucgugaccgccgagacgcagaacagcuccuucaucaucgacggccccaacacccccgagugccccagcgucucccgcgccuggaacgugugggagguggaggacuacggguucggcgucuucaccaccaacaucuggcucaagcugcgggagguguacacccagcugugcgaccaccgccucaugagcgcggccgugaaggacgagcgggccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccgcccgggcuaccacacccagacggccgggcccuggcaccucggcaagcuggagcuggacuucaacuacugcgagggcaccaccgucgugaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccugguguccgccggcagcgggaagguggacaacuucaccaugggcguccugugccucgccauccuguucgaggaggugaugcgcgggaaguucggcaagaagcacaugaucgccgggguguucuucaccuucguccugcuccuguccggccagaucaccuggcgggacauggcgcacacgcugaucaugaucggcagcaacgccuccgaccgcauggggaugggcgugaccuaccucgcccugaucgccaccuucaagauccagcccuuccuggcccucggguucuuccugcggaagcugaccagccgcgagaaccuccugcugggcgugggccucgcgauggccacgacccugcagcugcccgaggacaucgagcagauggccaacgggaucgcccucggccugauggcgcugaagcucaucacccaguucgagaucuaccagcuguggaccgcccugaucagccucacgugcuccaacaccaucuucacccugaccgucgccuggcggacggccacccugauccucgccggggugagccugcugccgaugugccaguccagcuccaugcgcaagaccgacuggcuccccauggcggucgccgccaugggcgugccgccccucccgcuguucaucuucagccucaaggacacccugaagcgccgguccuggccccugaacgagggggugauggccgucggccucgugagcauccuggccuccagccugcuccgcaacgacgugcccauggcgggcccccuggucgccgggggccugcucaucgccugcuacgugaucacggggaccuccgccgaccugaccguggagaaggccgcggacaucaccugggaggaggaggccgagcagacgggcgucagccacaaccugaugaucaccguggacgacgacgggaccaugcggaucaaggacgacgagaccgagaacauccucaccgugcugcugaagacggcccuccugaucgucuccggcaucuucccguacagcauccccgccacccugcucguguggcacaccuggcagaagcagacccagcgcuccggcgugcugugggacguccccagcccgcccgagacgcagaaggccgagcuggaggaggggguguaccggaucaagcagcagggcaucuucgggaagacccaggugggcgucggggugcagaaggagggcguguuccacaccauguggcacgucacccgcggcgcggugcucacguacaacgggaagcggcuggagcccaacugggccuccgugaagaaggaccugaucagcuacggcgggggcuggcgccucuccgcccaguggcagaagggggaggagguccaggugaucgccguggagcccggcaagaaccccaagaacuuccagaccaugcccggcaccuuccagaccacgaccggggagaucggcgcgaucgcccuggacuucaagcccgggaccagcggcagccccaucaucaaccgggagggcaaggucguggggcuguacggcaacgggguggucaccaagaacggcggguacguguccggcaucgcccagacgaacgccgagccggacggccccacccccgagcuggaggaggagauguucaagaagcgcaaccucaccaucauggaccugcaccccgggagcggcaagacccggaaguaccugccggccaucgugcgcgaggcgaucaagcggcgccuccggacgcugauccuggcccccacccgcgucguggccgccgagauggaggaggcccucaaggggcugcccauccgguaccagaccaccgcgacgaaguccgagcacaccggccgcgagaucguggaccugaugugccacgccaccuucaccaugcggcuccugagccccguccgcgugccgaacuacaaccugaucaucauggacgaggcccacuucacggaccccgccuccaucgccgcgcggggguacaucagcacccgcgugggcaugggcgaggccgccgccaucuucaugaccgcgacgccgcccgggacggccgacgccuucccgcaguccaacgcccccauccaggacgaggagcgcgacauccccgagcggagcuggaacuccggcaacgaguggaucaccgacuucgccgggaagaccgucugguucgugcccagcaucaaggcgggcaacgacaucgccaacugccuccgcaagaacgggaagaaggugauccagcugucccggaagaccuucgacacggaguaccagaagaccaagcugaacgacugggacuucgucgugaccaccgacaucagcgagaugggcgccaacuucaaggccgaccgcgugaucgacccgcggcgcugccucaagcccgucauccugacggacggccccgagcgggugauccuggccgggcccaugccggugaccgcggccuccgccgcccagcgccggggccgcgucgggcggaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgcgagaaguccgccgccaucgacggcgaguaccggcugaagggcgagucccgcaagacguucguggagcugaugcggcgcggggaccuccccguguggcuggcgcacaaggucgccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcaccuacuccgacccgcuggcccucaaggaguucaaggaguucgccgcgggccgcaagagcaucgcccuggaccuggucacggagaucgggcgcgugcccucccaccucgcccaccggacccgcaacgcccuggacaaccuggugaugcuccacaccagcgagcacggcgggcgggccuaccgccacgcggucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacgcuggccgccaucaucgccgcgaacgagaugggccugcucgagaccaccaagcgcgaccugggcauguccaaggagccgggggucgugagccccaccuccuaccuggacguggaccuccaccccgccagcgccuggacgcuguacgccgucgcgaccaccgugaucacccccaugcugcggcacacgaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugaccgccgccgugcuccugcugaucacgcacuacgccaucaucggccccggccuccaggcgaaggccacccgcgaggcccagaagcggaccgccgccgggaucaugaagaacccgaccguggacggcaucaugacgaucgaccuggaccccgucaucuacgacuccaaguucgagaagcagcugggccaggugaugcuccuggugcugugcgucgugcagcuccugcugaugcgcaccagcugggcgcucugcgaggcccugacccuggccaccggccccaucacgacccucugggagggcucccccgggaaguucuggaacaccaccaucgccgugagcauggcgaacaucuuccggggcuccuaccuggccggggccggccuggccuucagcaucaugaaguccgucgggacgggcaagcgcggcaccgggagccagggcgagacccucggggagaaguggaagaagaagcugaaccagcugagccggaaggacuucgaccucuacaagaaguccggcaucaccgagguggaccgcaccgaggccaaggaggggcugaagcggggcgagaucacgcaccacgcggugagccgcggcuccgccaagcugcagugguucgucgagcggaacauggugaucccggaggggcgcgugaucgaccucggcugcgggcggggcggguggagcuacuacugcgccggccugaagaaggucaccgaggugcgcggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccggguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacgcacgagauguacuggaucuccaacggcaccgggaacaucguggccagcgucaacauggugucccgccuccugcugaaccgguucaccaugacccaccgccggccgacgaucgagaaggacguggaccucggcgccggcacccgccacgucaacgcggagcccgagacccccaacauggacaucaucggggagcggaucaagcgcaucaaggaggagcacaacagcaccuggcacuacgacgacgagaacccguacaagacgugggccuaccacggcuccuacgaggugaaggccaccgggagcgccuccagcaugaucaacggcguggucaagcugcugaccaagcccugggacgugguccccauggugacccagauggccaugacggacaccacccccuucgggcagcagcggguguucaaggagaaggucgacacccgcacgccgcggagcaugcccggcacccgccgggugaugggcaucaccgcggaguggcucuggcgcacccuggggcggaacaagaagccccgccugugcacgcgcgaggaguucaccaagaaggugcggaccaacgccgccaugggcgccgucuucaccgaggagaaccagugggacuccgcgaaggccgccguggaggacgaggacuucuggaagcucgugaaccgcgagcgggagcugcacaagcuggggaagugcggcagcugcgucuacaacaugauggggaagcgcgagaagaagcucggcgaguucggcaaggccaaggggucccgggccaucugguacauguggcugggcgcgcgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacacggccgggugggacacccggaucaccgaggacgaccugcacaacgaggagaagaucacccagcagauggacccggagcaccgccagcucgcgaacgccaucuucaagcugacguaccagaacaagguggucaaggugcagcggcccacccccaccggcaccgugauggacaucaucagccgcaaggaccagcggggcuccgggcaggucggcaccuacgggcugaacacguucaccaacauggaggcccagcucauccgccagauggagggcgagggggugcugagcaaggccgaccuggagaacccccaccucccggagaagaagaucacccaguggcuggagaccaagggcguggagcggcugaagcgcauggccaucuccggcgacgacugcgucgugaagcccaucgacgaccgguucgcgaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggccggcuggucccucaaggagacggcgugccugggcaaggccuacgcccagauguggagccugauguacuuccaccgccgggaccuccgccuggccuccaacgcgaucugcagcgccguccccgugcacugggugccgaccucccggaccaccuggagcauccacgcccaccaccaguggaugacgaccgaggacaugcugaccgucuggaaccgcguguggaucgaggacaaccccuggauggaggacaagacccccgugacgaccugggagaacguccccuaccucgggaagcgggaggaccaguggugcggcagccugaucgggcugaccucccgcgccaccugggcccagaacaucccgacggcgauccagcagguccggagccucaucggcaacgaggaguuccuggacuacaugcccuccaugaagcgcuuccggaaggaggaggagagcgagggggccaucugguga

SEQ ID NO: 10056 - RNA, 9873 nt, Artificial Sequence
  derived and/or modified CDS sequence (opt1) from DENV-3__JF937646__SS-prME
accagccugugccucaugaugauccugcccgcggcccuggcguuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcguggggaucggcaaccgcgacuucguggagggccuguccggggccaccugggucgacguggugcuggagcacggcgggugcgucaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacguggaccggggguggggcaacgggugcggccucuucgggaagggcucccuggugaccugcgccaaguuccagugccuggagcccaucgagggcaagguggugcaguacgagaaccucaaguacacggucaucaucaccgugcacaccggggaccagcaccaggugggcaacgagacccagggggucacggccgagaucacgccccaggccagcaccaccgaggcgauccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggucaccuucaagaacgcccacgccaagaagcaggagguggugguccuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacgcguucgugcugaagaaggagguguccgagacccagcacgggaccauccucaucaaggucgaguacaagggcgaggacgugccgugcaagauccccuucagcaccgaggacgggcagggcaaggcccacaacggccgccugaucacggccaaccccguggucaccaagaaggaggagcccgugaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgucggcggggugcucaacagccugggcaagauggugcaccagaucuucggguccgccuacacggcccuguucagcggcgucuccugggugaugaagaucggcaucggggugcuccugaccuggaucggccugaacagcaagaacaccuccaugagcuucuccugcaucgccaucgggaucaucacccucuaccugggcgccgucgugcaggcggacauggggugcgugaucaacuggaagggcaaggagcugaagugcggcagcgggaucuucgucacgaacgaggugcacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgugucccgggcguggaacgucugggagguggaggacuacggguucggcguguucaccaccaacaucuggcucaagcugcgcgaggucuacacccagcugugcgaccaccggcucaugagcgccgccgugaaggacgagcgcgccgugcacgccgacaugggcuacuggaucgagagccagaagaacggguccuggaagcuggagaaggcgagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgccauccuguucgaggaggucaugcgggggaaguucggcaagaagcacaugaucgcggggguguucuucaccuucgugcugcuccuguccggccagaucaccuggcgcgacauggcccacacccugaucaugaucggcagcaacgccuccgaccggauggggaugggcgucacguaccucgcccugaucgccaccuucaagauccagcccuuccuggcgcucggguucuuccugcgcaagcugaccagccgggagaaccuccugcugggcgugggccucgccauggugaccacgcugcagcugcccgaggacaucgagcagauggccaacgggaucgcccucggccugauggcgcugaagcucaucacccaguucgagaccuaccagcuguggaccgcccugaucagccucacgugcuccaacaccaucuucacccugaccgucgccuggcgcacggccacccugauccucgccggggugagccugcugccggucugccaguccagcuccaugcggaagaccgacuggcuccccauggcgguggccgccaugggcgugccgccccucccgcuguucaucuucgggcucaaggacacccugaagcgccgcagcuggccccugaacgagggcgucauggccgugggccucguguccauccuggccagcucccugcuccggaacgacguccccauggcggggccccugguggccggcgggcugcucaucgccugcuacgugaucacgggcaccagcgccgaccugaccgucgagaaggccgcggacaucaccugggaggaggaggccgagcagacgggggugucccacaaccugaugaucaccguggacgacgacggcaccaugcgcaucaaggacgacgagaccgagaacauccucaccguccugcugaagacggcccuccugaucgugagcggcaucuucccguacuccauccccgccacccugcucguguggcacaccuggcagaagcagacccagcggagcgggguccugugggacgugcccagcccgcccgagacgcagaaggccgagcuggaggagggcguguaccgcaucaagcagcaggggaucuucggcaagacccaggucggggugggcgugcagaaggagggcgucuuccacaccauguggcacgugacccgcggggcggugcucacguacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggaccuuccagaccacgaccggcgagaucggggcgaucgcccuggacuucaagcccggcaccuccggcagccccaucaucaaccgcgaggggaagguggugggccuguacgggaacggcgucgugaccaagaacgggggcuacgugagcggcaucgcccagacgaacgccgagccggacgggcccacccccgagcuggaggaggagauguucaagaagcggaaccucaccaucauggaccugcaccccggcuccgggaagacccgcaaguaccugccggccaucguccgggaggcgaucaagcgccggcuccgcacgcugauccuggcccccacccgggugguggccgccgagauggaggaggcccucaagggccugcccauccgcuaccagaccaccgcgaccaaguccgagcacaccgggcgggagaucgucgaccugaugugccacgccaccuucaccaugcgccuccugucccccgugcgggugccgaacuacaaccugaucaucauggacgaggcccacuucacggaccccgccagcaucgccgcgcgcggcuacaucuccacccgggucggcaugggggaggccgccgccaucuucaugaccgcgacgccgcccggcacggccgacgccuucccgcagagcaacgcccccauccaggacgaggagcgcgacauccccgagcgcuccuggaacagcgggaacgaguggaucaccgacuucgccggcaagaccgugugguucgugcccuccaucaaggucgggaacgacaucgcgaacugccuccggaagaacggcaagaaggugauccagcugagccgcaagaccuucgacacggaguaccagaagaccaagcugaacgacugggacuucguggucaccaccgacaucuccgagaugggcgccaacuucaaggccgaccgggugaucgacccgcgccggugccucaagcccgugauccugacggacgggcccgagcgcgucauccuggccggccccaugccggugaccgccgcgagcgccgcccagcggcgcgggcgggugggccgcaacccccagaaggagaacgaccaguacaucuucaccgggcagccccucaacaacgacgaggaccacgcccacuggaccgaggccaagaugcugcuggacaacaucaacacccccgagggcaucaucccggcccucuucgagcccgagcgggagaaguccgccgccaucgacggcgaguaccgccugaagggggagagccggaagacguucgucgagcugaugcgccggggcgaccuccccguguggcuggcccacaaggucgcguccgaggggaucaaguacaccgaccgcaaguggugcuucgacggccagcggaacaaccagauccuggaggagaacauggacguggagaucuggaccaaggagggcgagaagaagaagcuccgcccccgguggcuggacgcccgcaccuacagcgacccgcuggcccucaaggaguucaaggaguucgccgccgggcgcaaguccaucgcgcuggaccuggugacggagaucggccggguccccagccaccucgcccaccgcacccggaacgcccuggacaaccuggugaugcuccacaccuccgagcacgggggccgcgccuaccggcacgccguggaggagcugcccgagaccauggagacgcugcuccugcuggggcucaugauccugcugaccggcggcgcgaugcuguuccugaucagcgggaagggcaucgggaagaccagcaucggccugaucugcgucaucgccuccagcgggaugcucuggauggccgagaucccgcugcaguggaucgccuccgccaucgugcuggaguucuucaugauggugcuccugauccccgagcccgagaagcagcgcacgccccaggacaaccagcuggcguacgucgugaucggcauccucacgcuggccgccaucaucgccgccaacgagaugggccugcucgagaccaccaagcgggaccuggggaugagcaaggagccgggcguggucucccccaccagcuaccuggacguggaccuccaccccgcguccgccuggacgcuguacgccguggccaccaccgucaucacccccaugcugcgccacacgaucgagaacagcaccgcgaacgugucccucgccgccaucgccaaccaggccgugguccugauggggcuggacaagggcuggccgaucagcaagauggaccucggggugccccugcuggcgcucggcugcuacucccaggugaacccccugacccugaccgccgccguccuccugcugaucacgcacuacgccaucaucggccccgggcuccaggccaaggcgacccgggaggcccagaagcgcaccgccgccggcaucaugaagaacccgaccguggacgggaucaugacgaucgaccuggaccccgugaucuacgacagcaaguucgagaagcagcugggccaggucaugcuccuggugcugugcgccgugcagcuccugcugaugcggaccuccugggcgcucugcgaggcccugacccuggccaccggccccaucacgacccucugggaggggagccccggcaaguucuggaacaccaccaucgccgucuccauggcgaacaucuuccgcgggagcuaccuggccggcgccgggcuggccuucuccaucaugaaguccgugggcacgggcaagcgggggaccggcucccagggggagacccucggcgagaaguggaagaagaagcugaaccagcugagccgcaaggacuucgaccucuacaagaaguccgggaucaccgagguggaccggaccgaggccaaggagggccugaagcgcggcgagaucacgcaccacgcggucucccgggggagcgccaagcugcagugguucguggagcgcaacauggugaucccggagggccgggucaucgaccucgggugcggccgcgggggcugguccuacuacugcgccggccugaagaaggugaccgaggugcggggguacaccaagggcgggcccggccacgaggagcccguccccaugagcaccuacggguggaacaucgugaagcugauguccggcaaggacguguucuaccucccgcccgagaagugcgacacgcugcugugcgacaucggcgagagcucccccagccccaccgucgaggagucccgcaccauccgcgugcugaagaugguggagccguggcucaagaacaaccaguucugcaucaagguccugaaccccuacaugcccaccgugaucgagcaccuggagcggcuccagcgcaagcacgggggcaugcuggugcggaacccccugagccgcaacuccacgcacgagauguacuggaucagcaacgggaccggcaacaucgucgccuccgugaacauggugagccggcuccugcugaaccgcuucaccaugacccaccggcgcccgacgaucgagaaggacgucgaccucggcgccgggacccggcacgugaacgcggagcccgagacccccaacauggacgugaucggcgagcgcaucaagcggaucaaggaggagcacaacuccaccuggcacuacgacgacgagaacccguacaagacgugggccuaccacgggagcuacgaggucaaggccaccggcuccgccagcuccaugaucaacgggguggucaagcugcugaccaagcccugggacguggugcccauggucacccagauggccaugacggacaccacccccuucggccagcagcgcguguucaaggagaagguggacacccggacgccgcgcagcaugcccggcacccggcgcgucauggggaucaccgcggaguggcucuggcggacccugggccgcaacaagaagccccggcugugcacgcgcgaggaguucaccaagaaggugcgcaccaacgccgccaugggggccguguucaccgaggagaaccagugggacagcgcgaaggccgccgucgaggacgaggacuucuggaagcucguggaccgggagcgcgagcugcacaagcugggcaagugcggguccugcguguacaacaugaugggcaagcgggagaagaagcucggcgaguucgggaaggccaagggcagccgcgccaucugguacauguggcugggggcgcgguaccuggaguucgaggcccucggcuuccugaacgaggaccacugguucucccgcgagaacagcuacuccggggucgagggcgagggccugcacaagcucggguacauccugcgggacaucagcaagauccccggcggggccauguacgccgacgacacggccggcugggacacccgcaucaccgaggacgaccugcacaacgaggagaagaucacccagcagauggacccggagcaccggcagcucgcgaacgccaucuucaagcugacguaccagaacaagguggugaagguccagcgccccacccccaccggcaccgugauggacaucaucucccggaaggaccagcgcgggagcggccagguggggaccuacggccugaacacguucaccaacauggaggcccagcucauccggcagauggagggggagggcguccuguccaaggccgaccuggagaacccccaccucccggagaagaagaucacccaguggcuggagaccaagggcguggagcgccugaagcggauggccaucagcggggacgacugcguggucaagcccaucgacgaccgcuucgcgaacgcccuccuggcccugaacgacaugggcaaggugcggaaggacaucccccaguggcagcccuccaagggguggcacgacuggcagcaggucccguucugcagccaccacuuccacgagcucaucaugaaggacggccgcaagcuggucgugcccugccggccccaggacgagcugaucgggcgcgcccggaucucccagggcgccggcuggagccucaaggagacggcgugccuggggaaggccuacgcccagauguggucccugauguacuuccaccgccgcgaccuccggcuggccagcaacgcgaucugcuccgccgugcccguccacugggugccgaccagccgcaccaccugguccauccacgcccaccaccaguggaugacgaccgaggacaugcugaccguguggaaccgggucuggaucgaggacaaccccuggauggaggacaagacccccgugacgaccugggagaacgugcccuaccucggcaagcgcgaggaccaguggugcgggagccugaucggccugaccagccgggccaccugggcccagaacaucccgacggcgauccagcagguccgcucccucaucgggaacgaggaguuccuggacuacaugcccagcaugaagcgguuccgcaaggaggaggaguccgagggcgccaucugguga

SEQ ID NO: 10057 - RNA, 9873 nt, Artificial Sequence
  derived and/or modified CDS sequence (opt1) from DENV-3__JF937633__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucgggcucaaggacacgcugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugaccgucgagaaggccgcggacaucacgugggaggaggaggccgagcagaccggggugucccacaaccugaugaucaccguggacgacgacggcaccaugcgcaucaaggacgacgagaccgagaacauccucacgguccugcugaagaccgcccuccugaucgugagcggcaucuucccguacuccauccccgccacccugcucguguggcacaccuggcagaagcagacgcagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacaccauguggcacgugacgcgcggggcggugcucaccuacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggaccuuccagacgaccaccggcgagaucggggcgaucgcccuggacuucaagcccggcaccuccggcagccccaucaucaaccgcgaggggaagguggugggccuguacgggaacggcgucgugacgaagaacgggggcuacgugagcggcaucgcccagaccaacgccgagccggacgggcccacccccgagcuggaggaggagauguucaagaagcggaaccucaccaucauggaccugcaccccggcuccgggaagacgcgcaaguaccugccggccaucguccgggaggcgaucaagcgccggcuccgcacccugauccuggcccccacccgggugguggccgccgagauggaggaggcccucaagggccugcccauccgcuaccagaccacggcgaccaagagcgagcacaccgggcgggagaucgucgaccugaugugccacgccaccuucacgaugcgccuccugucccccgugcgggugccgaacuacaaccugaucaucauggacgaggcccacuucaccgaccccgccagcaucgccgcgcgcggcuacaucuccacccgggucggcaugggggaggccgccgccaucuucaugaccgcgacgccgcccggcaccgccgacgccuucccgcagagcaacgcccccauccaggacgaggagcgcgacauccccgagcgcuccuggaacagcgggaacgaguggaucaccgacuucgccggcaagaccgugugguucgugcccuccaucaaggcggggaacgacaucgccaacugccuccggaagaacggcaagaaggucauccagcugagccgcaagacguucgacaccgaguaccagaagaccaagcugaacgacugggacuucguggugaccacggacaucuccgagaugggcgccaacuucaaggccgaccgggucaucgacccgcgccggugccucaagcccgugauccugaccgacgggcccgagcgcgugauccuggccggccccaugccggucaccgcggccagcgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacgcccgagggcaucaucccggcccucuucgagcccgagcgggagaaguccgccgccaucgacggcgaguaccgccugaagggggagagccggaagaccuucguggagcugaugcgccggggcgaccuccccgucuggcuggcgcacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcacguacagcgacccgcuggcccucaaggaguucaaggaguucgccgcggggcgcaaguccaucacccuggaccuggugaccgagaucggccgggugcccagccaccucgcccaccgcacccggaacgcccuggacaaccuggucaugcuccacacguccgagcacgggggccgcgccuaccggcacgccguggaggagcugcccgagaccauggagacccugcuccugcuggggcucaugauccugcugaccggcggcgcgaugcuguuccugaucagcgggaagggcaucgggaagacgagcaucggccugaucugcgugaucgccuccagcgggaugcucuggauggccgagaucccgcugcaguggaucgccuccgccaucguccuggaguucuucaugauggugcuccugauccccgagcccgagaagcagcgcacgccccaggacaaccagcuggcguacguggucaucggcauccucacccuggccgccaucaucgccgccaacgagaugggccugcucgagaccacgaagcgggaccuggggaugagcaaggagccgggcguggugucccccaccagcuaccuggacgucgaccuccaccccgcguccgccuggacccuguacgccguggccaccacggugaucacccccaugcugcgccacaccaucgagaacagcaccgcgaacgucucccucgccgccaucgccaaccaggccguggugcugauggggcuggacaagggcuggccgaucagcaagauggaccucggggucccccugcuggcgcucggcugcuacucccaggugaacccccugacgcugaccgccgccgugcuccugcugaucacccacuacgccaucaucggccccgggcuccaggccaaggcgacccgggaggcccagaagcgcacggccgccggcaucaugaagaacccgaccgucgacgggaucaugaccaucgaccuggaccccgugaucuacgacagcaaguucgagaagcagcugggccaggugaugcuccugguccugugcgccgugcagcuccugcugaugcggaccuccugggcgcucugcgaggcccugacgcuggccaccggccccaucaccacccucugggaggggagccccggcaaguucuggaacacgaccaucgccguguccauggcgaacaucuuccgcgggagcuaccuggccggcgccgggcuggccuucuccaucaugaaguccgucggcaccggcaagcgggggaccggcucccagggggagacccucggcgagaaguggaagaagaagcugaaccagcugagccgcaaggacuucgaccucuacaagaaguccgggaucacggagguggaccggaccgaggccaaggagggccugaagcgcggcgagaucacccaccacgcggugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacacgaagggcgggcccggccacgaggagcccgugcccaugagcaccuacggguggaacaucgucaagcugauguccggcaaggacguguucuaccucccgcccgagaagugcgacacccugcugugcgacaucggcgagagcucccccagccccaccguggaggagucccgcacgauccgcguccugaagaugguggagccguggcucaagaacaaccaguucugcaucaaggugcugaaccccuacaugcccaccgucaucgagcaccuggagcggcuccagcgcaagcacgggggcaugcuggugcggaacccccugagccgcaacuccacccacgagauguacuggaucagcaacgggaccggcaacaucguggccuccgucaacauggugagccggcuccugcugaaccgcuucacgaugacccaccggcgcccgaccaucgagaaggacguggaccucggcgccgggacccggcacgucaacgcggagcccgagacgcccaacauggacgugaucggcgagcgcaucaagcggaucaaggaggagcacaacuccaccuggcacuacgacgacgagaacccguacaagaccugggccuaccacgggagcuacgaggugaaggccaccggcuccgccagcuccaugaucaacggggucgugaagcugcugacgaagcccugggacgucgugcccauggugacccagauggccaugaccgacaccacgcccuucggccagcagcgcgucuucaaggagaagguggacacccggaccccgcgcagcaugcccggcacccggcgcgugauggggaucacggcggaguggcucuggcggacccugggccgcaacaagaagccccggcugugcacccgcgaggaguucaccaagaagguccgcacgaacgccgccaugggggccguguucaccgaggagaaccagugggacagcgcgaaggccgccguggaggacgaggacuucuggaagcucgucgaccgggagcgcgagcugcacaagcugggcaagugcggguccugcguguacaacaugaugggcaagcgggagaagaagcucggcgaguucgggaaggccaagggcagccgcgccaucugguacauguggcugggggcgcgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgccgacgacaccgccggcugggacacccgcaucacggaggacgaccugcacaacgaggagaagaucacccagcagauggacccggagcaccggcagcucgcgaacgccaucuucaagcugaccuaccagaacaaggucgugaaggugcagcgccccacccccaccggcacggucauggacaucaucucccggaaggaccagcgcgggagcggccagguggggaccuacggccugaacaccuucaccaacauggaggcccagcucauccggcagauggagggggagggcgugcuguccaaggccgaccuggagaacccccaccucccggagaagaagaucacgcaguggcuggagaccaagggcgucgagcgccugaagcggauggccaucagcggggacgacugcguggugaagcccaucgacgaccgcuucgcgaacgcccuccuggcccugaacgacaugggcaagguccggaaggacaucccccaguggcagcccuccaagggguggcacgacuggcagcaggucccguucugcagccaccacuuccacgagcucaucaugaaggacggccgcaagcuggugguccccugccggccccaggacgagcugaucgggcgcgcccggaucucccagggcgccggcuggagccucaaggagaccgcgugccuggggaaggccuacgcccagauguggucccugauguacuuccaccgccgcgaccuccggcuggccagcaacgcgaucugcuccgccgugcccgugcacugggucccgaccagccgcacgaccugguccauccacgcccaccaccaguggaugaccaccgaggacaugcugacgguguggaaccggguguggaucgaggacaaccccuggauggaggacaagacccccgucaccaccugggagaacgugcccuaccucggcaagcgcgaggaccaguggugcgggagccugaucggccugacgagccgggccaccugggcccagaacaucccgaccgcgauccagcagguccgcucccucaucgggaacgaggaguuccuggacuacaugcccagcaugaagcgguuccgcaaggaggaggaguccgagggcgccaucugguga

SEQ ID NO: 10058 - RNA, 9873 nt, Artificial Sequence
  derived and/or modified CDS sequence (opt1) from DENV-3__JF937634__SS-prME
accagccucugccucaugaugauccugcccgccgcccuggcguuccaccucaccagccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgugaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggcgaagaucgucaccgccgagacgcagaacagcuccuucaucaucgacggccccaacacccccgagugccccagcgugucccgggccuggaacgugugggaggucgaggacuacggguucggcguguucaccaccaacaucuggcucaagcugcgcgagguguacacccagcugugcgaccaccggcucaugagcgccgcggucaaggacgagcgcgccgugcacgccgacaugggcuacuggaucgagagccagaagaacggguccuggaagcuggagaaggccagccugaucgaggugaagacgugcaccuggccgaagucccacacccucuggagcaacggcguccuggaguccgacaugaucauccccaagagccuggccgggcccaucucccagcacaaccaccggccgggcuaccacacccagacggcggggcccuggcaccucggcaagcuggagcuggacuucaacuacugcgagggcaccaccguggugaucaccgagaacugcgggacgcgcggccccagccuccggaccaccaccgucuccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaaggucgacaacuucaccaugggcgugcugugccucgccauccuguucgaggaggugaugcgggggaaguucggcaagaagcacaugaucgccggggucuucuucaccuucgugcugcuccuguccggccagaucaccuggcgcgacauggcccacacgcugaucaugaucggcagcaacgcguccgaccggauggggaugggcgugaccuaccucgcccugaucgccaccuucaagauccagcccuuccuggcccucggguucuuccugcgcaagcugaccagccgggagaaccuccugcugggcgucggccucgccauggcgacgacccugcagcugcccgaggacaucgagcagauggccaacgggaucgcccucggccugauggcccugaagcucaucacccaguucgagaccuaccagcuguggacggcgcugaucagccugaccugcuccaacaccaucuucacccugacgguggccuggcgcaccgccacccugauccucgccggggucagccugcugccggugugccaguccagcuccaugcggaagaccgacuggcuccccauggccguggcggccaugggcgugccgccccucccgcuguucaucuucgggcucaaggacacgcugaagcgccgcagcuggccccugaacgagggcgugauggccgugggccucgucuccauccuggccagcucccugcuccggaacgacgugcccauggccgggccccugguggcgggcgggcugcucaucgccugcuacgucaucaccggcaccagcgccgaccugaccguggagaaggccgccgacaucacgugggaggaggaggcggagcagaccggggugucccacaaccugaugaucaccgucgacgacgacggcaccaugcgcaucaaggacgacgagaccgagaacauccucacggugcugcugaagaccgcccuccugaucgugagcggcaucuucccguacuccauccccgccacccugcucgucuggcacaccuggcagaagcagacgcagcggagcggggugcugugggacgugcccagcccgcccgagacccagaaggccgagcuggaggagggcgucuaccgcaucaagcagcaggggaucuucggcaagacccaggugggggugggcguccagaaggagggcguguuccacaccauguggcacgugacgcgcggggcgguccucaccuacaacggcaagcgccuggagcccaacugggcgagcgugaagaaggaccugaucuccuacgggggcggguggcggcucagcgcccaguggcagaagggcgaggaggugcaggucaucgccguggagcccggcaagaaccccaagaacuuccagaccaugcccgggaccuuccagacgaccaccggcgagaucggggccaucgcgcuggacuucaagcccggcaccuccggcagccccaucaucaaccgcgaggggaagguggucggccuguacgggaacggcguggugacgaagaacgggggcuacgucagcggcaucgcccagaccaacgccgagccggacgggcccacccccgagcuggaggaggagauguucaagaagcggaaccucaccaucauggaccugcaccccggcuccgggaagacgcgcaaguaccugccggccaucgugcgggaggccaucaagcgccggcuccgcacccugauccuggcgcccacccggguggucgccgccgagauggaggaggcccucaagggccugcccauccgcuaccagaccacggccaccaagagcgagcacaccgggcgggagaucguggaccugaugugccacgcgaccuucacgaugcgccuccugucccccgugcgggucccgaacuacaaccugaucaucauggacgaggcccacuucaccgaccccgccagcaucgccgcccgcggcuacaucuccacccgggugggcaugggggaggcggccgccaucuucaugaccgccacgccgcccggcaccgcggacgccuucccgcagagcaacgcccccauccaggacgaggagcgcgacauccccgagcgcuccuggaacagcgggaacgaguggaucaccgacuucgccggcaagaccgugugguucguccccuccaucaaggccgggaacgacaucgcgaacugccuccggaagaacggcaagaaggugauccagcugagccgcaagacguucgacaccgaguaccagaagaccaagcugaacgacugggacuucguggucaccacggacaucuccgagaugggcgccaacuucaaggccgaccgggugaucgacccgcgccggugccucaagcccgugauccugaccgacgggcccgagcgcgucauccuggccggccccaugccggugaccgccgcgagcgccgcccagcggcgcgggcgggugggccgcaacccccagaaggagaacgaccaguacaucuucaccgggcagccccucaacaacgacgaggaccacgcccacuggaccgaggccaagaugcugcuggacaacaucaacacgcccgagggcaucaucccggcccucuucgagcccgagcgggagaaguccgccgccaucgacggcgaguaccgccugaagggggagagccggaagaccuucgucgagcugaugcgccggggcgaccuccccguguggcuggcccacaaggucgcguccgaggggaucaaguacaccgaccgcaaguggugcuucgacggccagcggaacaaccagauccuggaggagaacauggacguggagaucuggaccaaggagggcgagaagaagaagcuccgcccccgguggcuggacgcccgcacguacagcgacccgcuggcccucaaggaguucaaggaguucgccgccgggcgcaaguccaucgcgcuggaccuggugaccgagaucggccggguccccagccaccucgcccaccgcacccggaacgcccuggacaaccuggugaugcuccacaccuccgagcacgggggccgcgccuaccggcacgccguggaggagcugcccgagacgauggagacccugcuccugcuggggcucaugauccugcugaccggcggcgcgaugcuguuccugaucagcgggaagggcaucgggaagaccagcaucggccugaucugcgucaucgccuccagcgggaugcucuggauggccgagaucccgcugcaguggaucgccuccgccaucgugcuggaguucuucaugauggugcuccugauccccgagcccgagaagcagcgcacgccccaggacaaccagcuggcguacgucgugaucggcauccucacccuggccgccaucaucgccgccaacgagaugggccugcucgagaccaccaagcgggaccuggggaugagcaaggagccgggcguggucucccccacgagcuaccuggacguggaccuccaccccgcguccgccuggacccuguacgccguggccaccaccgucaucacgcccaugcugcgccacaccaucgagaacagcaccgcgaacgugucccucgccgccaucgccaaccaggccgugguccugauggggcuggacaagggcuggccgaucagcaagauggaccucggggugccccugcuggcgcucggcugcuacucccaggugaacccccugacccugacggccgccguccuccugcugaucacccacuacgccaucaucggccccgggcuccaggccaaggcgacccgggaggcccagaagcgcaccgccgccggcaucaugaagaacccgacgguggacgggaucaugaccaucgaccuggaccccgugaucuacgacagcaaguucgagaagcagcugggccaggucaugcuccuggugcugugcgccgugcagcuccugcugaugcggaccuccugggcgcucugcgaggcccugacccuggccacgggccccaucaccacccucugggaggggagccccggcaaguucuggaacaccacgaucgccgucuccauggcgaacaucuuccgcgggagcuaccuggccggcgccgggcuggccuucuccaucaugaaguccgugggcaccggcaagcgggggaccggcucccagggggagacccucggcgagaaguggaagaagaagcugaaccagcugagccgcaaggacuucgaccucuacaagaaguccgggaucaccgagguggaccggacggaggccaaggagggccugaagcgcggcgagaucacccaccacgcggucucccgggggagcgccaagcugcagugguucguggagcgcaacauggugaucccggagggccgggucaucgaccucgggugcggccgcgggggcugguccuacuacugcgccggccugaagaaggugaccgaggugcggggguacaccaagggcgggcccggccacgaggagcccguccccaugagcacguacggguggaacaucgugaagcugauguccggcaaggacguguucuaccucccgcccgagaagugcgacacccugcugugcgacaucggcgagagcucccccagccccaccgucgaggagucccgcaccauccgcgugcugaagaugguggagccguggcucaagaacaaccaguucugcaucaagguccugaaccccuacaugcccacggugaucgagcaccuggagcggcuccagcgcaagcacgggggcaugcuggugcggaacccccugagccgcaacuccacccacgagauguacuggaucagcaacgggaccggcaacaucgucgccuccgugaacauggugagccggcuccugcugaaccgcuucaccaugacgcaccggcgcccgaccaucgagaaggacgucgaccucggcgccgggacccggcacgugaacgcggagcccgagacccccaacauggaggugaucggcgagcgcaucaagcggaucaaggaggagcacaacuccacguggcacuacgacgacgagaacccguacaagaccugggccuaccacgggagcuacgaggucaaggccaccggcuccgccagcuccaugaucaacgggguggucaagcugcugaccaagcccugggacguggugcccauggucacgcagauggccaugaccgacaccacccccuucggccagcagcgcguguucaaggagaagguggacacgcggaccccgcgcagcaugcccggcacccggcgcgucauggggaucaccgcggaguggcucuggcggacgcugggccgcaacaagaagccccggcugugcacccgcgaggaguucaccaagaaggugcgcaccaacgccgccaugggggccguguucacggaggagaaccagugggacagcgcgaaggccgccgucgaggacgaggacuucuggaagcucguggaccgggagcgcgagcugcacaagcugggcaagugcggguccugcguguacaacaugaugggcaagcgggagaagaagcucggcgaguucgggaaggccaagggcagccgcgccaucugguacauguggcugggggcgcgguaccuggaguucgaggcccucggcuuccugaacgaggaccacugguucucccgcgagaacagcuacuccggggucgagggcgagggccugcacaagcucggguacauccugcgggacaucagcaagauccccggcggggccauguacgccgacgacaccgccggcugggacacccgcaucaccgaggacgaccugcacaacgaggagaagaucacgcagcagauggacccggagcaccggcagcucgcggacgccaucuucaagcugaccuaccagaacaagguggugaagguccagcgccccacccccaccggcaccgugauggacaucaucucccggaaggaccagcgcgggagcggccagguggggacguacggccugaacaccuucaccaacauggaggcccagcucauccggcagauggagggggagggcguccuguccaaggccgaccuggagaacccccaccucccggagaagaagaucacccaguggcuggagacgaagggcguggagcgccugaagcggauggccaucagcggggacgacugcguggucaagcccaucgacgaccgcuucgcgaacgcccuccuggcccugaacgacaugggcaaggugcggaaggacaucccccaguggcagcccuccaagggguggcacgacuggcagcaggucccguucugcagccaccacuuccacgagcucaucaugaaggacggccgcaagcuggucgugcccugccggccccaggacgagcugaucgggcgcgcccggaucucccagggcgccggcuggagccucaaggagaccgcgugccuggggaaggccuacgcccagauguggucccugauguacuuccaccgccgcgaccuccggcuggccagcaacgcgaucugcuccgccgugcccguccacugggugccgaccagccgcaccacgugguccauccacgcccaccaccaguggaugaccaccgaggacaugcugaccguguggaaccgggucuggaucgaggacaaccccuggauggaggacaagacgcccgugaccaccugggagaacgugcccuaccucggcaagcgcgaggaccaguggugcgggagccugaucggccugaccagccgggccacgugggcccagaacaucccgaccgcgauccagcagguccgcucccucaucgggaacgaggaguuccuggacuacaugcccagcaugaagcgguuccgcaaggaggaggaguccgagggcgccaucugguga

SEQ ID NO: 10059 - RNA, 9873 nt, Artificial Sequence
  derived and/or modified CDS sequence (opt1) from DENV-3__JF937636__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcauccugugccucgccauccuguucgaggaggucaugcgggggaaguucggcaagaagcacaugaucgccgggguguucuucaccuucgugcugcuccuguccggccagaucaccuggcgcgacauggcgcacacgcugaucaugaucggcagcaacgccuccgaccggauggggaugggcgucaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacgguggccuggcgcaccgccacccugauccucgccggggucagccugcugccggugugccaguccagcuccaugcggaagaccgacuggcuccccauggcggucgccgccaugggcgugccgccccucccgcuguucaucuucagccucaaggacacgcugaagcgccgcuccuggccccugaacgagggggugauggccgucggccucgugagcauccuggccuccagccugcuccggaacgacgugcccauggcgggcccccuggucgccgggggccugcucaucgccugcuacgugaucaccgggaccuccgccgaccugaccguggagaaggccgcggacaucacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgauccgccggcgccuccggacccugauccuggcccccacccgcgucguggccgccgagauggaggaggcccucaaggggcugcccauccgguaccagaccacggcgaccaaguccgagcacaccggccgcgagaucguggaccugaugugccacgccaccuucacgaugcggcuccugagccccguccgcgugccgaacuacaaccugaucaucauggacgaggcccacuucaccgaccccgccuccaucgccgcgcggggguacaucagcacccgcgugggcaugggcgaggccgccgccaucuucaugaccgcgacgccgcccgggaccgccgacgccuucccgcaguccaacgcccccauccaggacgaggagcgcgacauccccgagcggagcuggaacuccggcaacgaguggaucaccgacuucgccgggaagaccgucugguucgugcccagcaucaaggcgggcaacgacaucgccaacugccuccgcaagaacgggaagaaggugauccagcugucccggaagacguucgacaccgaguaccagaagaccaagcugaacgacugggacuucgucgugaccacggacaucagcgagaugggcgccaacuucaaggccgaccgcgugaucgacccgcggcgcugccucaagcccgucauccugaccgacggccccgagcgggugauccuggccgggcccaugccggugaccgcggccuccgccgcccagcgccggggccgcgucgggcggaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgcgagaaguccgccgccaucgacggcgaguaccggcugaagggcgagucccgcaagaccuucguggagcugaugcggcgcggggaccuccccguguggcuggcgcacaaggucgccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcacguacuccgacccgcuggcccucaaggaguucaaggaguucgccgcgggccgcaagagcaucgcccuggaccuggucaccgagaucgggcgcgugcccucccaccucgcccaccggacccgcaacgcccuggacaaccuggugaugcuccacaccagcgagcacggcgggcgggccuaccgccacgcggucgaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccaccaagcgcgaccugggcauguccaaggagccgggggucgugagccccacguccuaccuggacguggaccuccaccccgccagcgccuggacccuguacgccgucgcgaccaccgugaucacgcccaugcugcggcacaccaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugacggccgccgugcuccugcugaucacccacuacgccaucaucggccccggccuccaggcgaaggccacccgcgaggcccagaagcggaccgccgccgggaucaugaagaacccgacgguggacggcaucaugaccaucgaccuggaccccgucaucuacgacuccaaguucgagaagcagcugggccaggugaugcuccuggugcugugcgcgguccagcuccugcugaugcgcaccagcugggcccucugcgaggcccugacccuggccacgggccccaucaccacccucugggagggcucccccgggaaguucuggaacaccacgaucgcggugagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggacuucgaccucuacaagaaguccggcaucaccgaggucgaccgcacggaggcgaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccgcaccauccgggugcugaagauggucgagccguggcucaagaacaaccaguucugcaucaaggugcugaaccccuacaugcccacggugaucgagcaccuggagcgccuccagcggaagcacggcgggaugcugguccgcaacccccugucccggaacagcacccacgagauguacuggaucuccaacggcaccgggaacaucguggccagcgugaacauggucucccgccuccugcugaaccgguucaccaugacgcaccgccggccgaccaucgagaaggacguggaccucggcgcgggcacccgccacgugaacgccgagcccgagacccccaacauggacgucaucggggagcggaucaagcgcaucaaggaggagcacaacagcacguggcacuacgacgacgagaacccguacaagaccugggccuaccacggcuccuacgaggugaaggccaccgggagcgccuccagcaugaucaacggcguggucaagcugcugaccaagcccugggacgugguccccauggugacgcagauggcgaugaccgacaccacccccuucgggcagcagcggguguucaaggagaaggucgacacgcgcaccccgcggagcaugcccggcacccgccgggugaugggcaucaccgccgaguggcucuggcgcacgcuggggcggaacaagaagccccgccugugcacccgcgaggaguucaccaagaaggugcggaccaacgccgccaugggcgcggucuucacggaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggucaaggugcagcggcccacccccaccggcaccgugauggacaucaucagccgcaaggaccagcggggcuccgggcaggucggcacguacgggcugaacaccuucaccaacauggaggcccagcucauccgccagauggagggcgagggggugcugagcaaggccgaccuggagaacccccaccucccggagaagaagaucacccaguggcuggagacgaagggcguggagcggcugaagcgcauggcgaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggcgggcuggucccucaaggagaccgccugccugggcaaggccuacgcccagauguggagccugauguacuuccaccgccgggaccuccgccuggcguccaacgccaucugcagcgccguccccgugcacugggugccgaccucccggaccacguggagcauccacgcccaccaccaguggaugaccaccgaggacaugcugaccgucuggaaccgcguguggaucgaggacaaccccuggauggaggacaagacgcccgugaccaccugggagaacguccccuaccucgggaagcgggaggaccaguggugcggcagccugaucgggcugaccucccgcgccacgugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 10060 - RNA, 9873 nt, Artificial Sequence
  derived and/or modified CDS sequence (opt1) from DENV-3__JF937626__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucgggcucaaggacacgcugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugaccgucgagaaggccgcggacaugacgugggaggaggaggccgagcagaccggggugucccacaaccugaugaucaccguggacgacgacggcaccaugcgcaucaaggacgacgagaccgagaacauccucacgguccugcugaagaccgcccuccugaucgugagcggcaucuucccguacuccauccccgccacccugcucguguggcacaccuggcagaagcagacgcagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacaccauguggcacgugacgcgcggggcggugcucaccuacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggaccuuccagacgaccaccggcgagaucggggcgaucgcccuggacuucaagcccggcaccuccggcagccccaucaucaaccgcgaggggaagguggugggccuguacgggaacggcgucgugacgaagaacgggggcuacgugagcggcaucgcccagaccaacgccgagccggacgggcccacccccgagcuggaggaggagauguucaagaagcggaaccucaccaucauggaccugcaccccggcuccgggaagacgcgcaaguaccugccggccaucguccgggaggcgaucaagcgccggcuccgcacccugauccuggcccccacccgggugguggccgccgagauggaggaggcccucaagggccugcccauccgcuaccagaccacggcgaccaagagcgagcacaccgggcgggagaucgucgaccugaugugccacgccaccuucacgaugcgccuccugucccccgugcgggugccgaacuacaaccugaucaucauggacgaggcccacuucaccgaccccgccagcaucgccgcgcgcggcuacaucuccacccgggucggcaugggggaggccgccgccaucuucaugaccgcgacgccgcccggcaccgccgacgccuucccgcagagcaacgcccccauccaggacgaggagcgcgacauccccgagcgcuccuggaacagcgggaacgaguggaucaccgacuucgccggcaagaccgugugguucgugcccuccaucaaggcggggaacgacaucgccaacugccuccggaagaacggcaagaaggucauccagcugagccgcaagacguucgacaccgaguaccagaagaccaagcugaacgacugggacuucguggugaccacggacaucuccgagaugggcgccaacuucaaggccgaccgggucaucgacccgcgccggugccucaagcccgugauccugaccgacgggcccgagcgcgugauccuggccggccccaugccggucaccgcggccagcgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacgcccgagggcaucaucccggcccucuucgagcccgagcgggagaaguccgccgccaucgacggcgaguaccgccugaagggggagagccggaagaccuucguggagcugaugcgccggggcgaccuccccgucuggcuggcgcacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcacguacagcgacccgcuggcccucaaggaguucaaggaguucgccgcggggcgcaaguccaucgcccuggaccuggugaccgagaucggccgggugcccagccaccucgcccaccgcacccggaacgcccuggacaaccuggucaugcuccacaccuccgagcacgggggccgcgccuaccggcacgcgguggaggagcugcccgagacgauggagacccugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgccuccgcgaucguccuggaguucuucaugauggugcuccugauccccgagcccgagaagcagcgcacgccccaggacaaccagcuggccuacguggucaucggcauccucacccuggccgccaucaucgccgcgaacgagaugggccugcucgagaccaccaagcgggaccuggggaugagcaaggagccgggcguggugucccccacgagcuaccuggacgucgaccuccaccccgccuccgccuggacccuguacgccguggcgaccaccgugaucacgcccaugcugcgccacaccaucgagaacagcaccgccaacgucucccucgccgccaucgccaaccaggcgguggugcugauggggcuggacaagggcuggccgaucagcaagauggaccucggggucccccugcuggcccucggcugcuacucccaggugaacccccugacccugacggccgccgugcuccugcugaucacccacuacgccaucaucggccccgggcuccaggcgaaggccacccgggaggcccagaagcgcaccgccgccggcaucaugaagaacccgacggucgacgggaucaugaccaucgaccuggaccccgugaucuacgacagcaaguucgagaagcagcugggccaggugaugcuccugguccugugcgcggugcagcuccugcugaugcggaccuccugggcccucugcgaggcccugacccuggccacgggccccaucaccacccucugggaggggagccccggcaaguucuggaacaccacgaucgcgguguccauggccaacaucuuccgcgggagcuaccuggccggcgccgggcuggccuucuccaucaugaaguccgucggcaccggcaagcgggggaccggcucccagggggagacccucggcgagaaguggaagaagaagcugaaccagcugagccgcaaggacuucgaccucuacaagaaguccgggaucaccgagguggaccggacggaggcgaaggagggccugaagcgcggcgagaucacccaccacgccgugucccgggggagcgccaagcugcagugguucgucgagcgcaacaugguggugccggagggccgggucaucgaccucgggugcggccgcgggggcugguccuacuacugcgccggccugaagaaggugaccgaggugcggggguacaccaagggcgggcccggccacgaggagcccguccccaugagcacguacggguggaacaucgugaagcugauguccggcaaggacguguucuaccucccgcccgagaagugcgacacccugcugugcgacaucggcgagagcucccccagccccaccgucgaggagucccgcaccauccgcgugcugaagaugguggagccguggcucaagaacaaccaguucugcaucaagguccugaaccccuacaugcccacggugaucgagcaccuggagcggcuccagcgcaagcacgggggcaugcuggugcggaacccccugagccgcaacuccacccacgagauguacuggaucagcaacgggaccggcaacaucgucgccuccgugaacauggugagccggcuccugcugaaccgcuucaccaugacgcaccggcgcccgaccaucgagaaggacgucgaccucggcgcggggacccggcacgugaacgccgagcccgagacccccaacauggacgugaucggcgagcgcaucaagcggaucaaggaggagcacaacuccacguggcacuacgacgacgagaacccguacaagaccugggccuaccacgggagcuacgaggucaaggccaccggcuccgccagcuccaugaucaacgggguggucaagcugcugaccaagcccugggacguggugcccauggucacgcagauggcgaugaccgacaccacccccuucggccagcagcgcguguucaaggagaagguggacacgcggaccccgcgcagcaugcccggcacccggcgcgucauggggaucaccgccgaguggcucuggcggacgcugggccgcaacaagaagccccggcugugcacccgcgaggaguucaccaagaaggugcgcaccaacgccgccaugggggcgguguucacggaggagaaccagugggacagcgccaaggccgccgucgaggacgaggacuucuggaagcucguggaccgggagcgcgagcugcacaagcugggcaagugcggguccugcguguacaacaugaugggcaagcgggagaagaagcucggcgaguucgggaaggccaagggcagccgcgcgaucugguacauguggcugggggcccgguaccuggaguucgaggcccucggcuuccugaacgaggaccacugguucucccgcgagaacagcuacuccggggucgagggcgagggccugcacaagcucggguacauccugcgggacaucagcaagauccccggcggggccauguacgccgacgacaccgcgggcugggacacccgcaucaccgaggacgaccugcacaacgaggagaagaucacgcagcagauggacccggagcaccggcagcucgccaacgccaucuucaagcugaccuaccagaacaagguggugaagguccagcgccccacccccaccggcaccgugauggacaucaucucccggaaggaccagcgcgggagcggccagguggggacguacggccugaacaccuucaccaacauggaggcccagcucauccggcagauggagggggagggcguccuguccaaggccgaccuggagaacccccaccucccggagaagaagaucacccaguggcuggagacgaagggcguggagcgccugaagcggauggcgaucagcggggacgacugcguggucaagcccaucgacgaccgcuucgccaacgcccuccuggcccugaacgacaugggcaaggugcggaaggacaucccccaguggcagcccuccaagggguggcacgacuggcagcaggucccguucugcagccaccacuuccacgagcucaucaugaaggacggccgcaagcuggucgugcccugccggccccaggacgagcugaucgggcgcgcccggaucucccagggcgcgggcuggagccucaaggagaccgccugccuggggaaggccuacgcccagauguggucccugauguacuuccaccgccgcgaccuccggcuggcgagcaacgccaucugcuccgccgugcccguccacugggugccgaccagccgcaccacgugguccauccacgcccaccaccaguggaugaccaccgaggacaugcugaccguguggaaccgggucuggaucgaggacaaccccuggauggaggacaagacgcccgugaccaccugggagaacgugcccuaccucggcaagcgcgaggaccaguggugcgggagccugaucggccugaccagccgggccacgugggcgcagaacaucccgaccgccauccagcagguccgcucccucaucgggaacgaggaguuccuggacuacaugcccagcaugaagcgguuccgcaaggaggaggaguccgagggcgccaucugguga

SEQ ID NO: 10061 - RNA, 9873 nt, Artificial Sequence
  derived and/or modified CDS sequence (opt1) from DENV-3__JF937621__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucgggcucaaggacacgcugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugaccgucgagcgcgccgcggacaucacgugggaggaggaggccgagcagaccggggugucccacaaccugaugaucaccguggacgacgacggcaccaugcggaucaaggacgacgagaccgagaacauccucacgguccugcugaagaccgcccuccugaucgugagcggcaucuucccguacuccauccccgccacccugcucguguggcacaccuggcagaagcagacgcagcgcagcgggguccugugggacgugcccagcccgcccgagacccagaaggccgagcuggaggagggcguguaccggaucaagcagcaggggaucuucggcaagacccaggucggggugggcgugcagaaggagggcgucuuccacaccauguggcacgugacgcgcggggcggugcucaccuacaacggcaagcggcuggagcccaacugggccagcgucaagaaggaccugaucuccuacgggggcggguggcgccucagcgcccaguggcagaagggcgaggagguccaggugaucgccgucgagcccggcaagaaccccaagaacuuccagaccaugcccgggaccuuccagacgaccaccggcgagaucggggcgaucgcccuggacuucaagcccggcaccuccggcagccccaucaucaaccgggaggggaagguggugggccuguacgggaacggcgucgugacgaagaacgggggcuacgugagcggcaucgcccagaccaacgccgagccggacgggcccacccccgagcuggaggaggagauguucaagaagcgcaaccucaccaucauggaccugcaccccggcuccgggaagacgcggaaguaccugccggccaucguccgcgaggcgaucaagcggcgccuccggacccugauccuggcccccacccgcgugguggccgccgagauggaggaggcccucaagggccugcccauccgguaccagaccacggcgaccaagagcgagcacaccgggcgcgagaucgucgaccugaugugccacgccaccuucacgaugcggcuccugucccccgugcgcgugccgaacuacaaccugaucaucauggacgaggcccacuucaccgaccccgccagcaucgccgcgcggggcuacaucuccacccgcgucggcaugggggaggccgccgccaucuucaugaccgcgacgccgcccggcaccgccgacgccuucccgcagagcaacgcccccauccaggacgaggagcgcgacauccccgagcgguccuggaacagcgggaacgaguggaucaccgacuucgccggcaagaccgugugguucgugcccuccaucaaggcggggaacgacaucgccaacugccuccgcaagaacggcaagaaggucauccagcugagccggaagacguucgacaccgaguaccagaagaccaagcugaacgacugggacuucguggugaccacggacaucuccgagaugggcgccaacuucaaggccgaccgcgucaucgacccgcggcgcugccucaagcccgugauccugaccgacgggcccgagcgggugauccuggccggccccaugccggucaccgcggccagcgccgcccagcgccgggggcgcgugggccggaacccccagaaggagaacgaccaguacaucuucaccgggcagccccucaacaacgacgaggaccacgcccacuggaccgaggcgaagaugcugcuggacaacaucaacacgcccgagggcaucaucccggcccucuucgagcccgagcgcgagaaguccgccgccaucgacggcgaguaccggcugaagggggagagccgcaagaccuucguggagcugaugcggcgcggcgaccuccccgucuggcuggcgcacaagguggccuccgaggggaucaaguacaccgaccggaaguggugcuucgacggccagcgcaacaaccagauccuggaggagaacauggacgucgagaucuggaccaaggagggcgagaagaagaagcuccggccccgcuggcuggacgcccgcacguacagcgacccgcuggcccucaaggaguucaaggaguucgccgcggggcggaaguccaucgcccuggaccuggugaccgagaucggccgcgugcccagccaccucgcccaccggacccgcaacgcccuggacaaccuggucaugcuccacaccuccgagcacgggggccgggccuaccgccacgcgguggaggagcugcccgagacgauggagacccugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgccuccgcgaucguccuggaguucuucaugauggugcuccugauccccgagcccgagaagcagcggacgccccaggacaaccagcuggccuacguggucaucggcauccucacccuggccgccaucaucgccgcgaacgagaugggccugcucgagaccaccaagcgcgaccuggggaugagcaaggagccgggcguggugucccccacgagcuaccuggacgucgaccuccaccccgccuccgccuggacccuguacgccguggcgaccaccgugaucacgcccaugcugcggcacaccaucgagaacagcaccgccaacgucucccucgccgccaucgccaaccaggcgguggugcugauggggcuggacaagggcuggccgaucagcaagauggaccucggggucccccugcuggcccucggcugcuacucccaggugaacccccugacccugacggccgccgugcuccugcugaucacccacuacgccaucaucggccccgggcuccaggcgaaggccacccgcgaggcccagaagcggaccgccgccggcaucaugaagaacccgacggucgacgggaucaugaccaucgaccuggaccccgugaucuacgacagcaaguucgagaagcagcugggccaggugaugcuccugguccugugcgcggugcagcuccugcugaugcgcaccuccugggcccucugcgaggcccugacccuggccacgggccccaucaccacccucugggaggggagccccggcaaguucuggaacaccacgaucgcgguguccauggccaacaucuuccgggggagcuaccuggccggcgccgggcuggccuucuccaucaugaaguccgucggcaccggcaagcgcgggaccggcucccagggggagacccucggcgagaaguggaagaagaagcugaaccagcugagccggaaggacuucgaccucuacaagaaguccgggaucaccgagguggaccgcacggaggcgaaggagggccugaagcggggcgagaucacccaccacgccgugucccgcgggagcgccaagcugcagugguucgucgagcggaacauggugaucccggagggccgcgugaucgaccucgggugcggccgcgggggcugguccuacuacugcgccggccugaagaaggucaccgaggugcgcggguacaccaagggcgggcccggccacgaggagcccgugcccaugagcacguacggguggaacaucgucaagcugauguccggcaaggacguguucuaccucccgcccgagaagugcgacacccugcugugcgacaucggcgagagcucccccagccccaccguggaggagucccgcaccauccggguccugaagaugguggagccguggcucaagaacaaccaguucugcaucaaggugcugaaccccuacaugcccacggucaucgagcaccuggagcgccuccagcggaagcacgggggcaugcuggugcgcaacccccugagccggaacuccacccacgagauguacuggaucagcaacgggaccggcaacaucguggccuccgucaacauggugagccgccuccugcugaaccgguucaccaugacgcaccgccggccgaccaucgagaaggacguggaccucggcgcggggacccgccacgucaacgccgagcccgagacccccaacauggacgugaucggcgagcggaucaagcgcaucaaggaggagcacaacuccacguggcacuacgacgacgagaacccguacaagaccugggccuaccacgggagcuacgaggugaaggccaccggcuccgccagcuccaugaucaacggggucgugaagcugcugaccaagcccugggacgucgugcccauggugacgcagauggcgaugaccgacaccacccccuucggccagcagcgggucuucaaggagaagguggacacgcgcaccccgcggagcaugcccggcacccgccgggugauggggaucaccgccgaguggcucuggcgcacgcugggccggaacaagaagccccgccugugcacccgcgaggaguucaccaagaagguccggaccaacgccgccaugggggcgguguucacggaggagaaccagugggacagcgccaaggccgccguggaggacgaggacuucuggaagcucgucgaccgcgagcgggagcugcacaagcugggcaagugcggguccugcguguacaacaugaugggcaagcgcgagaagaagcucggcgaguucgggaaggccaagggcagccgggcgaucugguacauguggcugggggcccgcuaccuggaguucgaggcccucggcuuccugaacgaggaccacugguucucccgggagaacagcuacuccgggguggagggcgagggccugcacaagcucggguacauccugcgcgacaucagcaagauccccggcggggccauguacgccgacgacaccgcgggcugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaccggcaccgucauggacaucaucucccgcaaggaccagcgggggagcggccagguggggacguacggccugaacaccuucaccaacauggaggcccagcucauccgccagauggagggggagggcgugcuguccaaggccgaccuggagaacccccaccucccggagaagaagaucacccaguggcuggagacgaagggcgucgagcggcugaagcgcauggcgaucagcggggacgacugcguggugaagcccaucgacgaccgguucgccaacgcccuccuggcccugaacgacaugggcaagguccgcaaggacaucccccaguggcagcccuccaagggguggcacgacuggcagcaggucccguucugcagccaccacuuccacgagcucaucaugaaggacggccggaagcuggugguccccugccgcccccaggacgagcugaucgggcgggcccgcaucucccagggcgcgggcuggagccucaaggagaccgccugccuggggaaggccuacgcccagauguggucccugauguacuuccaccgccgggaccuccgccuggcgagcaacgccaucugcuccgccgugcccgugcacugggucccgaccagccggaccacgugguccauccacgcccaccaccaguggaugaccaccgaggacaugcugaccguguggaaccgcguguggaucgaggacaaccccuggauggaggacaagacgcccgucaccaccugggagaacgugcccuaccucggcaagcgggaggaccaguggugcgggagccugaucggccugaccagccgcgccacgugggcgcagaacaucccgaccgccauccagcagguccggucccucaucgggaacgaggaguuccuggacuacaugcccagcaugaagcgcuuccggaaggaggaggaguccgagggcgccaucugguga

SEQ ID NO: 10062 - RNA, 9873 nt, Artificial Sequence
  derived and/or modified CDS sequence (opt1) from DENV-3__JF937623__SS-prME
gccagccugugccucaugaugauccugcccgccgcccuggccuuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugacgagcaccugggugaccuacgggaccugcaaccaggccggcgagcaccggcgcgacaagcgguccgucgcgcucgcgccccacgugggcauggggcuggacacgcgcacccagaccuggaugagcgccgagggcgccuggcgccagguggagaaggucgagaccugggcgcugcgccacccgggguucacgauccucgcccuguuccuggcccacuacaucggcaccucccucacccagaagguggugaucuucauccugcugaugcucgucacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccacgcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgcgaagaagcaggagguggucgugcuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgucucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggaucuucuucaccuucgugcugcuccuguccggccagaucaccuggcgcgacauggcccacacccugaucaugaucggcagcaacgccuccgaccggauggggaugggcgucacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccguggccuggcgcacggccacccugauccucgcgggggucagccugcugccggugugccaguccagcuccaugcggaagaccgacuggcuccccauggccgucgccgccaugggcgugccgccccucccgcuguucaucuucgggcucaaggacacccugaagcgccgcagcuggccccugaacgagggcgugauggccgucggccucguguccauccuggcgagcucccugcuccggaacgacgugcccauggccgggccccuggucgccggcgggcugcucaucgccugcuacgugaucacgggcaccagcgccgaccugaccguggagaaggcggccgacaugaccugggaggaggaggccgagcagacgggggucucccacaaccugaugaucaccguggacgacgacggcaccaugcgcaucaaggacgacgagaccgagaacauccucaccgugcugcugaagacggcccuccugaucgucagcggcaucuucccguacuccauccccgccacccugcucguguggcacaccuggcagaagcagacccagcggagcggggugcugugggacguccccagcccgcccgagacgcagaaggcggagcuggaggagggcaucuaccgcaucaagcagcaggggaucuucggcaagacccaggugggggugggcguccagaaggagggcguguuccacaccauguggcacgugacccgcggggccguccucacguacaacggcaagcgccuggagcccaacugggccagcgugaagaaggaccugaucuccuacgggggcggguggcggcucagcgcccaguggcagaagggcgaggaggugcaggucaucgcgguggagcccggcaagaaccccaagaacuuccagaccaugcccgggaccuuccagaccacgaccggcgagaucggggccaucgcccuggacuucaagcccggcaccuccggcagccccaucaucaaccgcgaggggaagguggucggccuguacgggaacggcguggugaccaagaacgggggcuacgucagcggcaucgcccagacgaacgccgagccggacgggcccacccccgagcuggaggaggagauguucaagaagcggaaccucaccaucauggaccugcaccccggcuccgggaagacccgcaaguaccugccggcgaucgugcgggaggccaucaagcgccggcuccgcacgcugauccuggcccccacccggguggucgccgccgagauggaggaggcgcucaagggccugcccauccgcuaccagaccaccgccaccaaguccgagcacaccgggcgggagaucguggaccugaugugccacgccaccuucaccaugcgccuccugucccccgugcgggucccgaacuacaaccugaucaucauggacgaggcccacuucacggaccccgccagcaucgcggcccgcggcuacaucuccacccgggugggcaugggggaggccgccgcgaucuucaugaccgccacgccgcccggcacggccgacgccuucccgcagagcaacgcccccauccaggacgaggagcgcgacauccccgagcgcuccuggaacagcgggaacgaguggaucaccgacuucgcgggcaagaccgugugguucguccccuccaucaaggccgggaacgacaucgccaacugccuccggaagaacggcaagaaggugauccagcugagccgcaagaccuucgacacggaguaccagaagaccaagcugaacgacugggacuucguggucaccaccgacaucuccgagaugggcgccaacuucaaggccgaccgggugaucgacccgcgccggugccucaagcccgugauccugacggacgggcccgagcgcgucauccuggcgggccccaugccggugaccgccgccagcgccgcccagcggcgcgggcgggugggccgcaacccccagaaggagaacgaccaguacaucuucaccgggcagccccucaacaacgacgaggaccacgcgcacuggaccgaggccaagaugcugcuggacaacaucaacacccccgagggcaucaucccggcccucuucgagcccgagcgggagaaguccgccgcgaucgacggcgaguaccgccugaagggggagagccggaagacguucgucgagcugaugcgccggggcgaccuccccguguggcuggcccacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcaccuacagcgacccgcuggcccucaaggaguucaaggaguucgcggccgggcgcaaguccaucgcccuggaccuggugacggagaucggccggguccccagccaccucgcccaccgcacccggaacgcccuggacaaccuggugaugcuccacaccuccgagcacgggggccgcgcguaccggcacgccguggaggagcugcccgagaccauggagacgcugcuccugcuggggcucaugauccugcugaccggcggcgccaugcuguuccugaucagcgggaagggcaucgggaagaccagcaucggccugaucugcgucaucgccuccagcgggaugcucuggauggccgagaucccgcugcaguggaucgcguccgccaucgugcuggaguucuucaugauggugcuccugauccccgagcccgagaagcagcgcacgccccaggacaaccagcuggccuacgucgugaucggcauccucacgcuggccgccaucaucgcggccaacgagaugggccugcucgagaccaccaagcgggaccuggggaugagcaaggagccgggcguggucucccccaccagcuaccuggacguggaccuccaccccgccuccgccuggacgcuguacgcgguggccaccaccgucaucacccccaugcugcgccacacgaucgagaacagcaccgccaacgugucccucgccgccaucgcgaaccaggccgugguccugauggggcuggacaagggcuggccgaucagcaagauggaccucggggugccccugcuggcccucggcugcuacucccaggugaacccccugacccugaccgccgccguccuccugcugaucacgcacuacgcgaucaucggccccgggcuccaggccaaggccacccgggaggcccagaagcgcaccgccgcgggcaucaugaagaacccgaccguggacgggaucaugacgaucgaccuggaccccgugaucuacgacagcaaguucgagaagcagcugggccaggucaugcuccuggugcugugcgccgugcagcuccugcugaugcggaccuccugggcccucugcgaggcccugacccuggcgaccggccccaucacgacccucugggaggggagccccggcaaguucuggaacaccaccaucgccgucuccauggccaacaucuuccgcgggagcuaccuggccggcgccgggcuggcguucuccaucaugaaguccgugggcacgggcaagcgggggaccggcucccagggggagacccucggcgagaaguggaagaagaagcugaaccagcugagccgcaaggacuucgaccucuacaagaaguccgggaucaccgagguggaccggaccgaggccaaggagggccugaagcgcggcgagaucacgcaccacgccgucucccgggggagcgccaagcugcagugguucguggagcgcaacauggugaucccggagggccgggucaucgaccucgggugcggccgcgggggcugguccuacuacugcgccggccugaagaaggugaccgaggugcggggguacaccaagggcgggcccggccacgaggagcccguccccaugagcaccuacggguggaacaucgugaagcugauguccggcaaggacguguucuaccucccgcccgagaagugcgacacgcugcugugcgacaucggcgagagcucccccagccccaccgucgaggagucccgcaccauccgcgugcugaagaugguggagccguggcucaagaacaaccaguucugcaucaagguccugaaccccuacaugcccaccgugaucgagcaccuggagcggcuccagcgcaagcacgggggcaugcuggugcggaacccccugagccgcaacuccacgcacgagauguacuggaucagcaacgggaccggcaacaucgucgcguccgugaacauggugagccggcuccugcugaaccgcuucaccaugacccaccggcgcccgacgaucgagaaggacgucgaccucggcgccgggacccggcacgugaacgccgagcccgagacccccaacauggacgugaucggcgagcgcaucaagcggaucaaggaggagcacaacuccaccuggcacuacgacgacgagaacccguacaagacgugggccuaccacgggagcuacgaggucaaggccaccggcuccgcgagcuccaugaucaacgggguggugaagcugcugaccaagcccugggacgucgugcccauggucacccagauggccaugacggacaccacccccuucggccagcagcgcguguucaaggagaagguggacacccggacgccgcgcagcaugcccggcacccggcgcgucauggggaucaccgccgaguggcucuggcggacccugggccgcaacaagaagccccggcugugcacgcgcgaggaguucaccaagaaggugcgcaccaacgccgcgaugggggccguguucaccgaggagaaccagugggacagcgccaaggccgccgucgaggacgaggacuucuggaagcucguggaccgggagcgcgagcugcacaagcugggcaagugcggguccugcguguacaacaugaugggcaagcgggagaagaagcucggcgaguucgggaaggcgaagggcagccgcgccaucugguacauguggcugggggcccgguaccuggaguucgaggcccucggcuuccugaacgaggaccacugguucucccgcgagaacagcuacuccggggucgagggcgagggccugcacaagcucggguacauccugcgggacaucagcaagauccccggcggggccauguacgcggacgacacggccggcugggacacccgcaucaccgaggacgaccugcacaacgaggagaagaucacccagcagauggacccggagcaccggcagcucgccaacgccaucuucaagcugacguaccagaacaagguggugaagguccagcgccccacccccaccggcaccgugauggacaucaucucccggaaggaccagcgcgggagcggccagguggggaccuacggccugaacacguucaccaacauggaggcccagcucauccggcagauggagggggagggcguccuguccaaggcggaccuggagaacccccaccucccggagaagaagaucacccaguggcuggagaccaagggcguggagcgccugaagcggauggccaucagcggggacgacugcguggucaagcccaucgacgaccgcuucgccaacgcccuccuggcccugaacgacaugggcaaggugcggaaggacaucccccaguggcagcccuccaagggguggcacgacuggcagcaggucccguucugcagccaccacuuccacgagcucaucaugaaggacggccgcaagcuggucgugcccugccggccccaggacgagcugaucgggcgcgcgcggaucucccagggcgccggcuggagccucaaggagacggccugccuggggaaggccuacgcgcagauguggucccugauguacuuccaccgccgcgaccuccggcuggccagcaacgccaucugcuccgccgugcccguccacugggugccgaccagccgcaccaccugguccauccacgcccaccaccaguggaugacgaccgaggacaugcugaccguguggaaccgggucuggaucgaggacaaccccuggauggaggacaagacccccgugacgaccugggagaacgugcccuaccucggcaagcgcgaggaccaguggugcgggagccugaucggccugaccagccgggcgaccugggcccagaacaucccgacggccauccagcagguccgcucccucaucgggaacgaggaguuccuggacuacaugcccagcaugaagcgguuccgcaaggaggaggaguccgagggcgccaucugguga

SEQ ID NO: 10063 - RNA, 9873 nt, Artificial Sequence
  derived and/or modified CDS sequence (opt1) from DENV-3__JF937637__SS-prME
accagccugugccucaugaugauccugcccgccgcccuggcguuccaccucaccagccgggacggcgagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacgcguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgucucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucgggcucaaggacacccugaagcgccgcagcuggccccugaacgagggcgucauggccgugggccucguguccauccuggcgagcucccugcuccggaacgacguccccauggccgggccccugguggccggcgggcugcucaucgccugcuacgugaucacgggcaccagcgccgaccugaccgucgagaaggcggccgacaucaccugggaggaggaggccgagcagacgggggugucccacaaccugaugaucaccguggacgacgacggcaccaugcgcaucaaggacgacgagaccgagaacauccucaccguccugcugaagacggcccuccugaucgugagcggcaucuucccguacuccauccccgccacccugcucguguggcacaccuggcagaagcagacccagcggagcgggguccugugggacgugcccagcccgcccgagacgcagaaggcggagcuggaggagggcguguaccgcaucaagcagcaggggaucuucggcaagacccaggucggggugggcgugcagaaggagggcgucuuccacaccauguggcacgugacccgcggggccgugcucacguacaacggcaagcgccuggagcccaacugggccagcgucaagaaggaccugaucuccuacgggggcggguggcggcucagcgcccaguggcagaagggcgaggagguccaggugaucgcggucgagcccggcaagaaccccaagaacuuccagaccaugcccgggaccuuccagaccacgaccggcgagaucggggccaucgcccuggacuucaagcccggcaccuccggcagccccaucaucaaccgcgaggggaagguggugggccuguacgggaacggcgucgugaccaagaacgggggcuacgugagcggcaucgcccagacgaacgccgagccggacgggcccacccccgagcuggaggaggagauguucaagaagcggaaccucaccaucauggaccugcaccccggcuccgggaagacccgcaaguaccugccggcgaucguccgggaggccaucaagcgccggcuccgcacgcugauccuggcccccacccgggugguggccgccgagauggaggaggcgcucaagggccugcccauccgcuaccagaccaccgccaccaaguccgagcacaccgggcgggagaucgucgaccugaugugccacgccaccuucaccaugcgccuccugucccccgugcgggugccgaacuacaaccugaucaucauggacgaggcccacuucacggaccccgccagcaucgcggcccgcggcuacaucuccacccgggucggcaugggggaggccgccgcgaucuucaugaccgccacgccgcccggcacggccgacgccuucccgcagagcaacgcccccauccaggacgaggagcgcgacauccccgagcgcuccuggaacagcgggaacgaguggaucaccgacuucgcgggcaagaccgugugguucgugcccuccaucaaggccgggaacgacaucgccaacugccuccggaagaacggcaagaaggucauccagcugagccgcaagaccuucgacacggaguaccagaagaccaagcugaacgacugggacuucguggugaccaccgacaucuccgagaugggcgccaacuucaaggccgaccgggucaucgacccgcgccggugccucaagcccgugauccugacggacgggcccgagcgcgugauccuggcgggccccaugccggucaccgccgccagcgccgcccagcggcgcgggcgggugggccgcaacccccagaaggagaacgaccaguacaucuucaccgggcagccccucaacaacgacgaggaccacgcgcacuggaccgaggccaagaugcugcuggacaacaucaacacccccgagggcaucaucccggcccucuucgagcccgagcgggagaaguccgccgcgaucgacggcgaguaccgccugaagggggagagccggaagacguucguggagcugaugcgccggggcgaccuccccgucuggcuggcccacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcaccuacagcgacccgcuggcccucaaggaguucaaggaguucgcggccgggcgcaaguccaucgcccuggaccuggugacggagaucggccgggugcccagccaccucgcccaccgcacccggaacgcccuggacaaccuggucaugcuccacaccuccgagcacgggggccgcgcguaccggcacgccguggaggagcugcccgagaccauggagacgcugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgcguccgccaucguccuggaguucuucaugauggugcuccugauccccgagcccgagaagcagcgcacgccccaggacaaccagcuggccuacguggucaucggcauccucacgcuggccgccaucaucgcggccaacgagaugggccugcucgagaccaccaagcgggaccuggggaugagcaaggagccgggcguggugucccccaccagcuaccuggacgucgaccuccaccccgccuccgccuggacgcuguacgcgguggccaccaccgugaucacccccaugcugcgccacacgaucgagaacagcaccgccaacgucucccucgccgccaucgcgaaccaggccguggugcugauggggcuggacaagggcuggccgaucagcaagauggaccucggggucccccugcuggcccucggcugcuacucccaggugaacccccugacccugaccgccgccgugcuccugcugaucacgcacuacgcgaucaucggccccgggcuccaggccaaggccacccgggaggcccagaagcgcaccgccgcgggcaucaugaagaacccgaccgucgacgggaucaugacgaucgaccuggaccccgugaucuacgacagcaaguucgagaagcagcugggccaggugaugcuccugguccugugcgccgugcagcuccugcugaugcggaccuccugggcccucugcgaggcccugacccuggcgaccggccccaucacgacccucugggaggggagccccggcaaguucuggaacaccaccaucgccguguccauggccaacaucuuccgcgggagcuaccuggccggcgccgggcuggcguucuccaucaugaaguccgucggcacgggcaagcgggggaccggcucccagggggagacccucggcgagaaguggaagaagaagcugaaccagcugagccgcaaggacuucgaccucuacaagaaguccgggaucaccgagguggaccggaccgaggccaaggagggccugaagcgcggcgagaucacgcaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacaccaagggcgggcccggccacgaggagcccgugcccaugagcaccuacggguggaacaucgucaagcugauguccggcaaggacguguucuaccucccgcccgagaagugcgacacgcugcugugcgacaucggcgagagcucccccagccccaccguggaggagucccgcaccauccgcguccugaagaugguggagccguggcucaagaacaaccaguucugcaucaaggugcugaaccccuacaugcccaccgucaucgagcaccuggagcggcuccagcgcaagcacgggggcaugcuggugcggaacccccugagccgcaacuccacgcacgagauguacuggaucagcaacgggaccggcaacaucguggcguccgucaacauggugagccggcuccugcugaaccgcuucaccaugacccaccggcgcccgacgaucgagaaggacguggaccucggcgccgggacccggcacgucaacgccgagcccgagacccccaacauggacgugaucggcgagcgcaucaagcggaucaaggaggagcacaacuccaccuggcacuacgacgacgagaacccguacaagacgugggccuaccacgggagcuacgaggugaaggccaccggcuccgcgagcuccaugaucaacggggucgugaagcugcugaccaagcccugggacgucgugcccauggugacccagauggccaugacggacaccacccccuucggccagcagcgcgucuucaaggagaagguggacacccggacgccgcgcagcaugcccggcacccggcgcgugauggggaucaccgccgaguggcucuggcggacccugggccgcaacaagaagccccggcugugcacgcgcgaggaguucaccaagaagguccgcaccaacgccgcgaugggggccguguucaccgaggagaaccagugggacagcgccaaggccgccguggaggacgaggacuucuggaagcucgucgaccgggagcgcgagcugcacaagcugggcaagugcggguccugcguguacaacaugaugggcaagcgggagaagaagcucggcgaguucgggaaggcgaagggcagccgcgccaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgcggacgacacggccggcugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucucccggaaggaccagcgcgggagcggccagguggggaccuacggccugaacacguucaccaacauggaggcccagcucauccggcagauggagggggagggcgugcugcugaaggcggaccucgagaacccccaccuccccgagaagaagaucacccaguggcuggagaccaagggcgucgagcgccugaagcggauggccaucuccggggacgacugcguggugaagcccaucgacgaccgcuucgccaacgcccugcuggcccucaacgacaugggcaagguccggaaggacaucccccaguggcagcccagcaagggguggcacgacuggcagcaggucccguucugcucccaccacuuccacgagcugaucaugaaggacggccgcaagcuggugguccccugccggccccaggacgagcucaucgggcgcgcgcggaucagccagggcgccggcuggucccugaaggagacggccugccuggggaaggccuacgcgcagauguggagccucauguacuuccaccgccgcgaccugcggcuggccuccaacgccaucugcagcgccgugcccgugcacugggucccgaccucccgcaccaccuggagcauccacgcccaccaccaguggaugacgaccgaggacaugcucaccguguggaaccggguguggaucgaggacaaccccuggauggaggacaagacccccgucacgaccugggagaacgugcccuaccugggcaagcgcgaggaccaguggugcgggucccugaucggccucaccagccgggcgaccugggcccagaacaucccgacggccauccagcagguccgcagccugaucgggaacgaggaguuccuggacuacaugcccuccaugaagcgguuccgcaaggaggaggagagcgagggcgccaucugguga

SEQ ID NO: 10064 - RNA, 9873 nt, Artificial Sequence
  derived and/or modified CDS sequence (opt1) from DENV-3__JF937638__SS-prME
accagccugugccuccugaugauccugcccgccgcccucgcguuccaccugaccagccgggacggggagccgcggaugaucguggggaagaacgagcggggcaagagccuccuguucaagaccgccagcgggaucaacaugugcacccugaucgccauggaccugggggagaugugcgacgacaccgugaccuacaagugcccccacaucaccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcgccagguggagaagguggagacgugggcccuccgccacccgggguucaccauccuggcgcuguuccucgcccacuacaucggcaccucccugacccagaagguggugaucuucauccugcucaugcuggugacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccacccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacacggugaucaucaccgugcacaccggggaccagcaccaggucggcaacgagacccagggggugacggccgagaucacgccccaggccagcaccaccgaggcgauccugcccgaguacggcacccucgggcuggagugcuccccgcgcacgggccuggacuucaacgagaugauccuccugaccaugaagaacaaggccuggaugguccaccggcagugguucuucgaccugccccuccccuggaccagcggcgccaccacggagacccccaccuggaaccgcaaggagcugcuggugaccuucaagaacgcccacgccaagaagcaggagguggucgugcucgggucccaggagggcgcgaugcacacggcccugaccggggccaccgagauccagaacagcggcgggaccuccaucuucgccggccaccugaagugccggcucaagauggacaagcuggagcugaagggcaugagcuacgccaugugcacgaacaccuucgugcucaagaaggaggucuccgagacccagcacgggaccauccugaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccucggcgacacggccugggacuucggguccgugggcggggugcugaacagccugggcaagaugguccaccagaucuucggguccgcguacaccgcccucuucagcggcguguccugggugaugaagaucggcaucgggguccugcugaccuggaucggccucaacagcaagaacaccuccaugagcuucuccugcaucgccaucgggaucaucacgcuguaccugggcgccguggugcaggccgacauggggugcgucaucaacuggaagggcaaggagcucaagugcggcagcgggaucuucgugaccaacgaggugcacaccuggaccgagcaguacaaguuccaggcggacucccccaagcgccuggccacggccaucgccggcgccugggagaacggggucugcggcauccgcagcaccacccggauggagaaccugcucuggaagcagaucgcgaacgagcugaacuacauccugugggagaacaacaucaagcucaccgugguggucggggacaucaucggcgugcuggagcagggcaagcgcacgcugacgccccagccgauggagcucaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcugaagcugcgcgagguguacacccagcucugcgaccaccggcugaugagcgcggccgugaaggacgagcgcgccguccacgccgacaugggcuacuggaucgagagccagaagaacggguccuggaagcuggagaaggccagccucaucgaggugaagacgugcaccuggccgaagucccacacccuguggagcaacggcgugcuggaguccgacaugaucauccccaagagccucgcggggcccaucucccagcacaaccaccggccgggcuaccacacccagacggccgggcccuggcaccugggcaagcuggagcucgacuucaacuacugcgagggcaccaccgucgugaucaccgagaacugcgggacgcgcggccccagccugcggaccaccaccguguccgggaagcugauccacgaguggugcugccgcagcugcacgcugccgccccugcgguacaugggcgaggacgggugcugguacggcauggagauccgccccaucuccgagaaggaggagaacauggucaagagccugguguccgccggcagcgggaagguggacaacuucaccaugggcguccucugccuggccauccuguucgaggaggugaugcgggggaaguucggcaagaagcacaugaucgccgggguguucuucaccuucguccuccugcuguccggccagaucaccuggcgcgacauggcgcacacgcucaucaugaucggcagcaacgccuccgaccggauggggaugggcgugaccuaccuggcccugaucgccaccuucaagauccagcccuuccucgcccugggguucuuccugcgccggcucaccagccgcgagaaccugcugcucggcgugggccuggcgauggccacgacccugcagcuccccgaggacaucgagcagauggccaacgggaucgcccugggccugauggcgcucaagcugaucacccaguucgagaccuaccagcuguggacggcccucaucagccugaccugcuccaacaccaucuucacccugacggucgccuggcggaccgccacccucauccuggccggggugagccugcuccccgucugccgcuccagcuccaugcgcaagaccgacuggcugcccauggcgguggccgccaugggcgugccgccccugccccucuucaucuucagccugaaggacacgcugaagcggcgcuccuggccccucaacgagggggucauggccgugggccuggugagcauccuggccuccagccuccugcggaacgacguccccauggcgggcccccugguggccgggggccuccugaucgccugcuacgugaucaccgggaccuccgccgaccugaccgucgagaaggccgcggacaucacgugggaggaggaggccgagcagaccggcgugagccacaaccucaugaucaccguggacgacgacgggaccaugcgcaucaaggacgacgagaccgagaacauccugacgguccugcucaagaccgcccugcugaucguguccggcaucuucccguacagcauccccgccacccuccugguguggcacaccuggcagaagcagacgcagcgguccggcguccugugggacgugcccuccccgcccgagacccagaaggccgagcucgaggaggggguguaccgcaucaagcagcagggcaucuucgggaagacccaggucggcgugggggugcagaaggagggcgucuuccacaccauguggcacgugacgcggggcgcggugcugaccuacaacgggaagcgccuggagcccaacugggccuccgucaagaaggaccucaucagcuacggcgggggcuggcggcuguccgcccaguggcagaagggggaggagguccaggugaucgccgucgagcccggcaagaaccccaagaacuuccagaccaugccgggcaccuuccagacgaccaccggggagaucggcgcgaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcucgaggaggagauguucaagaagcggaaccugaccaucauggaccugcaccccgggagcggcaagacgcgcaaguaccucccggccaucguccgggaggcgaucaagcgccggcugcgcacccugauccucgcccccacccgggugguggccgccgagauggaggaggcccugaaggggcugcccauccgcuaccagaccacggcgaccaaguccgagcacaccggccgggagaucgucgaccucaugugccacgccaccuucacgaugcgccugcugagccccgugcgggugccgaacuacaaccucaucaucauggacgaggcccacuucaccgaccccgccuccaucgccgcgcgcggguacaucagcacccgcgucggcaugggcgaggccgccgccaucuucaugaccgcgacgccgcccgggaccgccgacgccuucccgcaguccaacgcccccauccaggacgaggagcgggacauccccgagcgcagcuggaacuccggcaacgaguggaucaccgacuucgccgggaagaccgugugguucgugcccagcaucaaggcgggcaacgacaucgccaacugccugcggaagaacgggaagaaggucauccagcugucccgcaagacguucgacaccgaguaccagaagaccaagcucaacgacugggacuucguggugaccacggacaucagcgagaugggcgccaacuucaaggccgaccgggucaucgacccgcgccggugccugaagcccgugauccugaccgacggccccgagcgcgugauccucgccgggcccaugccggucaccgcggccuccgccgcccagcggcgcggccggguggggcgcaacccccagaaggagaacgaccaguacaucuucaccggccagccccugaacaacgacgaggaccacgcccacuggaccgaggcgaagaugcugcucgacaacaucaacacgcccgaggggaucaucccggcccuguucgagcccgagcgggagaaguccgccgccaucgacggcgaguaccgccugaagggcgagucccggaagaccuucguggagcucaugcgccgcggggaccugcccgucuggcuggcgcacaagguggccagcgagggcaucaaguacaccgaccgcaaguggugcuucgacgggcagcggaacaaccagauccucgaggagaacauggacgucgagaucuggaccaaggagggcgagaagaagaagcugcgcccccgcuggcuggacgcccggacguacuccgacccgcucgcccugaaggaguucaaggaguucgccgcgggccgcaagagcaucgcccuggaccucgugaccgagaucgggcgggugcccucccaccuggcccaccgcacccggaacgcccuggacaaccucgucaugcugcacaccagcgagcacggcgggcgcgccuaccggcacgcgguggaggagcugcccgagacgauggagacccuccugcugcucggccugaugauccugcucaccgggggcgccaugcuguuccugaucagcggcaaggggaucggcaagaccuccaucgggcucaucugcgugaucgccagcuccggcaugcuguggauggccgagaucccgcugcaguggaucgccagcgcgaucguccucgaguucuucaugauggugcugcugauccccgagcccgagaagcagcgcacgccccaggacaaccagcucgccuacguggucaucgggauccugacccuggccgccaucaucgccgcgaacgagaugggccuccuggagaccaccaagcgggaccugggcauguccaaggagccggggguggugagccccacguccuaccucgacgucgaccugcaccccgccagcgccuggacccuguacgccguggcgaccaccgugaucacgcccaugcuccgccacaccaucgagaacuccaccgccaacgucagccuggccgccaucgccaaccaggcgguggugcugaugggccucgacaagggguggccgaucuccaagauggaccugggcgucccccugcucgcccuggggugcuacagccaggugaacccccugacccucacggccgccgugcugcugcucaucacccacuacgccaucaucggccccggccugcaggcgaaggccacccgggaggcccagaagcgcaccgccgccgggaucaugaagaacccgacggucgacggcaucaugaccaucgaccuggaccccgugaucuacgacuccaaguucgagaagcagcucggccaggugaugcugcugguccucugcgcggugcagcugcugcucaugcggaccagcugggcccugugcgaggcccugacccucgccacgggccccaucaccacccugugggagggcucccccgggaaguucuggaacaccacgaucgcggugagcauggccaacaucuuccgcggcuccuaccuggccggggccggccucgccuucagcaucaugaaguccgucgggaccggcaagcggggcaccgggagccagggcgagacccugggggagaaguggaagcgcaagcugaaccagcucagccggaaggacuucgaccuguacaagaaguccggcaucaccgagguggaccgcacggaggcgaaggaggggcugaagcggggcgagaucacccaccacgccgugagccgcggcuccgccaagcuccagugguucgucgagcggaacauggugaccccggaggggcgcgugaucgaccugggcugcgggcgcggcggguggagcuacuacugcgccggccugaagaaggucaccgaggugcggggcuacacgaagggcgggcccgggcacgaggagcccgugcccauguccaccuacggcuggaacaucgucaagcucaugagcgggaaggacguguucuaccugccgcccgagaagugcgacacccugcugugcgacaucggcgaguccagccccucccccaccguggaggagagccgcacgauccggguccucaagaugguggagccguggcugaagaacaaccaguucugcaucaaggugcugaaccccuacaugcccaccgucaucgagcaccucgagcgccugcagcggaagcacggcgggaugcuggugcgcaacccccucucccggaacagcacccacgagauguacuggaucuccaacggcaccgggaacaucguggccagcgucaacauggugucccgccugcugcucaaccgguucacgaugacccaccgccggccgaccaucgagaaggacguggaccugggcgcgggcacccgccacgucaacgccgagcccgagacgcccaacauggacgugaucggggagcggaucaagcgcaucaaggaggagcacaaccugaccuggcacuacgacgacgagaacccguacaagaccugggccuaccacggcagcuacgaggugaaggccaccggguccgccagcuccaugaucaacggcgucgugaagcuccugacgaagcccugggacgucgugcccauggugacccagauggcgaugaccgacaccacgcccuucgggcagcagcgggucuucaaggagaagguggacacccgcaccccgcggagcaugcccggcacccgccgggugaugggcaucacggccgaguggcuguggcgcacccucgggcgcaacaagaagccccggcugugcacccgcgaggaguucaccaagaagguccggacgaacgccgccaugggcgcgguguucaccgaggagaaccagugggacagcgccaaggccgccguggaggacgaggacuucuggaagcuggucgaccgcgagcgggagcuccacaagcuggggaagugcggcuccugcguguacaacaugauggggaagcgcgagaagaagcugggcgaguucggcaaggccaaggggagccgggcgaucugguacauguggcucggcgcccgcuaccuggaguucgaggcccugggguuccucaacgaggaccacugguucucccgggagaacagcuacuccggcguggagggggagggccugcacaagcugggcuacauccuccgcgacaucagcaagauccccgggggcgccauguacgccgacgacaccgcggggugggacacccggaucacggaggacgaccugcacaacgaggagaagaucacccagcagauggacccggagcaccgccagcuggccaacgccaucuucaagcucaccuaccagaacaaggucgugaaggugcagcggcccacccccaccggcacggucauggacaucaucucccgcaaggaccagcggggcagcggccaggugggcaccuacgggcugaacaccuucaccaacauggaggcccagaucauccgccagauggagggcgagggggugcuguccaaggccgaccucgagaacccccaccucccggagaagaagaucacgcaguggcuggagaccaagggcgucgagcggcucaagcgcauggcgaucagcggcgacgacugcguggugaagcccaucgacgaccgguucgccaacgcccugcuggcccucaacgacauggggaagguccgcaaggacaucccccaguggcagcccuccaagggcuggcacgacuggcagcaggucccguucugcagccaccacuuccacgagcugaucaugaaggacgggcggaagcuggugguccccugccgcccccaggacgagcucaucggccgcgcccggaucucccagggggcgggcuggagccugaaggagaccgccugccugggcaaggccuacgcccagauguggucccucauguacuuccaccgccgggaccugcgccuggcgagcaacgccaucugcuccgccgugcccgugcacugggucccgaccagccggacgaccugguccauccacgcccaccaccaguggaugaccaccgaggacaugcucacgguguggaaccgcguguggaucgaggacaaccccuggauggaggacaagacccccgucaccaccugggagaacgugcccuaccuggggaagcgggaggaccaguggugcggcagccugaucgggcucacgagccgcgccaccugggcgcagaacaucccgaccgccauccagcagguccggucccugaucggcaacgaggaguuccuggacuacaugcccagcaugaagcgcuuccggaaggaggaggaguccgagggggccaucugguga

SEQ ID NO: 10065 - RNA, 9873 nt, Artificial Sequence
  derived and/or modified CDS sequence (opt1) from DENV-3__JF937639__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgcgccgugcaagauccccuucagcacggaggacgggcagggcaaggcccacaacggccgccugaucaccgccaaccccguggucaccaagaaggaggagcccgugaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacacggcgugggacuucggguccgucggcggggugcucaacagccugggcaagauggugcaccagaucuucggguccgccuacaccgcccuguucagcggcgucuccugggugaugaagaucggcaucggggugcuccugaccuggaucggccugaacagccgcaacaccuccaugagcuucuccugcaucgccaucgggaucaucacgcucuaccugggcgccgucgugcaggcggacauggggugcgugaucaacuggaagggcaaggagcugaagugcggcagcgggaucuucgucaccaacgaggugcacaccuggaccgagcaguacaaguuccaggccgacucccccaagcgccucgccacggccaucgccggcgcgugggagaacggggugugcggcauccggagcaccacccgcauggagaaccugcuguggaagcagaucgccaacgagcucaacuacauccugugggagaacaacaucaagcugaccgucguggugggggacaucaucggcguccucgagcagggcaagcggacgcugacgccccagccgauggagcugaaguacuccuggaagaccugggggaaggccaagaucgugaccgccgagacgcagaacagcuccuucaucaucgacggccccaacacccccgagugccccagcgugucccgcgcguggaacgucugggagguggaggacuacggguucggcguguucaccaccaacaucuggcucaagcugcgggaggccuacacccagcugugcgaccaccgccucaugagcgccgccgucaaggacgagcgggccgugcacgcggacaugggcuacuggaucgagagccagaagaacggguccuggaagcuggagaaggccagccugaucgaggugaagacgugcaccuggccgaagucccacaccaucuggagcaacggcguccucgaguccgacaugaucauccccaagagccuggccgggcccaucucccagcacaaccaccgcccgggcuaccacacccagacggccgggcccuggcaccugggcaagcucgagcuggacuucaacuacugcgagggcaccaccguggugaucaccgagaacugcgggacgcggggccccagccugcgcaccaccaccgucuccgggaagcucauccacgaguggugcugccggagcugcacgcugcccccgcugcgcuacaugggcgaggacgggugcugguacggcauggagauccggcccaucuccgagaaggaggagaacauggucaagagccucguguccgccggcagcgggaaggucgacaacuucaccaugggcgugcugugccuggcgauccucuucgaggaggugaugcgcgggaaguucggcaagaagcacaugaucgccggggucuuccugaccuucgugcugcuccuguccggccagaucaccuggcgggacauggcccacacgcugaucaugaucggcagcaacgccuccgaccgcauggggaugggcgugaccuaccucgcccugaucgcgaccuucaagauccagcccuuccuggcccucggguucuuccugcggaagcugaccagccgcgagaaccuccugcugggcgucggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccaucuucacccugacgguggccuggcggaccgcgacccugauccucgccggggugagccugcugccggucugccaguccagcuccaugcgcaagaccgacuggcuccccauggccguggccgccaugggcgugccgccccucccgcuguucaucuucagccucaaggacacgcugaagcgccgguccuggccccugaacgagggggugauggcggugggccucgucagcauccuggccuccagccugcuccgcaacgacgugcccauggccggcccccugguggccgggggccugcucaucgccugcuacgucaucaccgggaccuccgcggaccugaccguggagaaggccgccgacaucacgugggaggaggaggccgagcagaccggcgugagccacaaccugaugaucaccgucgacgacgacgggaccaugcggaucaaggacgacgagaccgagaacauccucacggugcugcugaagaccgcccuccugaucguguccggcaucuucccguacagcauccccgcgacccugcucgucuggcacaccuggcagaagcagacgaagcgcuccggcgugcugugggacgugcccagcccgcccgagacccagaaggccgagcuggaggagggggucuaccggaucaagcagcagggcaucuucgggaagacccaggugggcguggggguccagaaggagggcguguuccacaccauguggcacgugacgcgcggcgccguccucaccuacaacgggaagcggcuggagcccaacugggccuccgugaagaaggaccugaucagcuacggcgggggcuggcgccucuccgcgcaguggcagaagggggaggaggugcaggucaucgccguggagcccggcaagaaccccaagaacuuccagaccaugcccggcaccuuccagacgaccaccggggagaucggcgccaucgcccuggacuucaagcccgggaccagcggcagccccaucaucaaccgggagggcaagguggucgggcuguacggcaacgggguggugacgaagaacggcggguacgucuccggcaucgcccagaccaacgcggagccggacggccccacccccgagcuggaggaggagauguucaagaagcgcaaccucaccaucauggaccugcaccccgggagcggcaagacgcggaaguaccugccggccaucgugcgcgaggccaucaagcggcgccuccggacccugauccuggcccccacccgcguggucgccgcggagauggaggaggcccucaaggggcugcccauccgguaccagaccacggccaccaaguccgagcacaccggccgcgagaucguggaccugaugugccacgccaccuucacgaugcggcuccugagccccgugcgcgucccgaacuacaaccugaucaucauggacgaggcccacuucaccgaccccgcguccaucgccgcccggggguacaucagcacccgcgugggcaugggcgaggccgcggccaucuucaugaccgccacgccgcccgggaccgccgacgccuucccgcaguccaacgcgcccauccaggacgaggagcgcgacauccccgagcggagcuggaacuccggcaacgaguggaucaccgacuucgccgggaagaccgugugguucguccccagcaucaaggccggcaacgacaucgccaacugccuccgcaagaacgggaagaaggugauccagcugucccggaagacguucgacaccgaguaccagaagaccaagcugaacgacugggacuucguggucaccacggacaucagcgagaugggcgccaacuucaaggcggaccgcgugaucgacccgcggcgcugccucaagcccgugauccugaccgacggccccgagcgggucauccuggccgggcccaugccggugaccgccgccuccgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgcgagaaguccgcggccaucgacggcgaguaccggcugaagggcgagucccgcaagaccuucgucgagcugaugcggcgcggggaccuccccguguggcuggcccacaagguggccagcgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccgcacguacuccgacccgcuggcgcucaaggaguucaaggaguucgccgccggccgcaagagcaucgcccuggaccuggugaccgagaucgggcgcguccccucccaccucgcccaccggacccgcaacgcgcuggacaaccuggugaugcuccacaccagcgagcacggcgggcgggccuaccgccacgccguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggcggagaucccgcugcaguggaucgccagcgccaucgugcuggaguucuucaugauggugcuccugauccccgagcccgagaagcagcggacgccccaggacaaccagcuggccuacgucgugaucgggauccucacccuggccgcgaucaucgccgccaacgagaugggccugcucgagaccaccaagcgcgaccugggcauguccaaggagccggggguggucagccccacguccuaccuggacguggaccuccaccccgccagcgcguggacccuguacgccguggccaccaccgucaucacgcccaugcugcggcacaccaucgagaacuccaccgccaacgugagccucgccgcgaucgccaaccaggccgugguccugaugggccuggacaagggguggccgaucuccaagauggaccucggcgugccccugcuggcccucgggugcuacagccaggugaacccccugacccugacggccgcgguccuccugcugaucacccacuacgccaucaucggccccggccuccaggccaaggccacccgcgaggcccagaagcggaccgcggccgggaucaugaagaacccgacgguggacggcaucaugaccaucgaccuggaccccgugaucuacgacuccaaguucgagaagcagcuggggcaggucaugcuccuggugcugugcgccgugcagcuccugcugaugcgcaccagcugggcccucugcgaggcgcugacccuggccacgggccccaucaccacccucugggagggcucccccgggaaguucuggaacaccacgaucgccgucagcauggccaacaucuuccggggcuccuaccuggccggggcgggccuggccuucagcaucaugaaguccguggggaccggcaagcgcggcaccgggagccagggcgagacccucggggagaaguggaagaagaagcugaaccagcugagccggaaggacuucgaccucuacaagaaguccggcaucaccgagguggaccgcacggaggccaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgcgggccugaagaaggugaccgaggugcgcggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccgcaccauccgggugcugaagaugguggagccguggcucaagaacaaccaguucugcaucaagguccugaaccccuacaugcccacggugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucaccaugacgcaccgccggccgaccaucgagaaggacgucgaccucggcgccggcacccgccacgugaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggcgaccgggagcgccuccagcaugaucaacggcguggugaagcugcugaccaagcccugggacgucgugcccauggucacgcagauggccaugaccgacaccacccccuucgggcagcagcggguguucaaggagaagguggacacgcgcaccccgcggagcaugcccggcacccgccgggucaugggcaucaccgccgaguggcucuggcgcacgcuggggcggaacaagaagccccgccugugcacccgcgaggaguucaccaagaaggugcggaccaacgcggccaugggcgccguguucacggaggagaaccagugggacuccgccaaggccgcggucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggccaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgcgauguacgccgacgacaccgccgggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucagccgcaaggaccagcggggcuccggccaggugggcacguacgggcugaacaccuucaccaacauggaggcgcagcucauccgccagauggagggcgaggggguccugagcaaggccgaccuggagaacccccaccucccggagaagaagaucacccaguggcuggagacgaagggcguggagcggcugaagcgcauggccaucuccggcgacgacugcguggucaagcccaucgacgaccgguucgccaacgcccuccuggcgcugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggccggcuggucccucaaggagaccgccugccugggcaaggcguacgcccagauguggagccugauguacuuccaccgccgggaccuccgccuggccuccaacgccaucugcagcgccgugcccguccacugggugccgaccucccggaccacguggagcauccacgcgcaccaccaguggaugaccaccgaggacaugcugaccguguggaaccgcgucuggaucgaggacaaccccuggauggaggacaagacgcccgugaccaccugggagaacgugcccuaccucgggaagcgggaggaccaguggugcggcagccugaucgggcugaccucccgcgccacgugggcccagaacaucccgaccgccauccagcagguccggagccucaucggcaacgaggaguuccuggacuacaugcccuccaugaagcgcuuccggaaggaggaggagagcgagggggccaucugguga

SEQ ID NO: 10066 - RNA, 9873 nt, Artificial Sequence
  derived and/or modified CDS sequence (opt1) from DENV-3__JF937627__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagcgggaggagcccgugaacaucgaggccgagccgcccuucggggagagcaacaucgucaucggcaucggggacaacgcccugaagaucaacugguacaagaagggcuccagcaucgggaagauguucgaggcgaccgcccgcggcgcccggcgcauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccggagcaccacccgcauggagaaccugcuguggaagcagaucgcgaacgagcucaacuacauccugugggagaacaacaucaagcugaccgugguggucggggacaucaucggcgugcucgagcagggcaagcggacgcugacgccccagccgauggagcugaaguacuccuggaagaccugggggaaggccaagaucgugaccgccgagacgcagaacagcuccuucaucaucgacggccccaacacccccgagugccccagcgucucccgcgccuggaacgugugggagguggaggacuacggguucggcgucuucaccaccaacaucuggcucaagcugcgggagguguacacccagcugugcgaccaccgccucaugagcgcggccgugaaggacgagcgggccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccgcccgggcuaccacacccagacggccgggcccuggcaccucggcaagcuggagcuggacuucaacuacugcgagggcaccaccgucgugaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccugguguccgccggcagcgggaagguggacaacuucaccaugggcguccugugccucgccauccuguucgaggaggugaugcgcgggaaguucggcaagaagcacaugaucgccgggguguucuucaccuucguccugcuccuguccggccagaucaccuggcgggacauggcgcacacgcugaucaugaucggcagcaacgccuccgaccgcauggggaugggcgugaccuaccucgcccugaucgccaccuucaagauccagcccuuccuggcccucggguucuuccugcggaagcugaccagccgcgagaaccuccugcugggcgugggccucgcgauggccacgacccugcagcugcccgaggacaucgagcagauggccaacgggaucgcccucggccugauggcgcugaagcucaucacccaguucgagaucuaccagcuguggaccgcccugaucagccucacgugcuccaacaccaucuucacccugaccgucgccuggcggacggccacccugauccucgccggggugagccugcugccgaugugccaguccagcuccaugcgcaagaccgacuggcuccccauggcggucgccgccaugggcgugccgccccucccgcuguucaucuucagccucaaggacacccugaagcgccgguccuggccccugaacgagggggugauggccgucggccucgugagcauccuggccuccagccugcuccgcaacgacgugcccauggcgggcccccuggucgccgggggccugcucaucgccugcuacgugaucacggggaccuccgccgaccugaccguggagaaggccgcggacaucaccugggaggaggaggccgagcagacgggcgucagccacaaccugaugaucaccguggacgacgacgggaccaugcggaucaaggacgacgagaccgagaacauccucaccgugcugcugaagacggcccuccugaucgucuccggcaucuucccguacagcauccccgccacccugcucguguggcacaccuggcagaagcagacccagcgcuccggcgugcugugggacguccccagcccgcccgagacgcagaaggccgagcuggaggaggggguguaccggaucaagcagcagggcaucuucgggaagacccaggugggcgucggggugcagaaggagggcguguuccacaccauguggcacgucacccgcggcgcggugcucacguacaacgggaagcggcuggagcccaacugggccuccgugaagaaggaccugaucagcuacggcgggggcuggcgccucuccgcccaguggcagaagggggaggagguccaggugaucgccguggagcccggcaagaaccccaagaacuuccagaccaugcccggcaccuuccagaccacgaccggggagaucggcgcgaucgcccuggacuucaagcccgggaccagcggcagccccaucaucaaccgggagggcaaggucguggggcuguacggcaacgggguggucaccaagaacggcggguacguguccggcaucgcccagacgaacgccgagccggacggccccacccccgagcuggaggaggagauguucaagaagcgcaaccucaccaucauggaccugcaccccgggagcggcaagacccggaaguaccugccggccaucgugcgcgaggcgaucaagcggcgccuccggacgcugauccuggcccccacccgcgucguggccgccgagauggaggaggcccucaaggggcugcccauccgguaccagaccaccgcgacgaaguccgagcacaccggccgcgagaucguggaccugaugugccacgccaccuucaccaugcggcuccugagccccguccgcgugccgaacuacaaccugaucaucauggacgaggcccacuucacggaccccgccuccaucgccgcgcggggguacaucagcacccgcgugggcaugggcgaggccgccgccaucuucaugaccgcgacgccgcccgggacggccgacgccuucccgcaguccaacgcccccauccaggacgaggagcgcgacauccccgagcggagcuggaacuccggcaacgaguggaucaccgacuucgccgggaagaccgucugguucgugcccagcaucaaggcgggcaacgacaucgccaacugccuccgcaagaacgggaagaaggugauccagcugucccggaagaccuucgacacggaguaccagaagaccaagcugaacgacugggacuucgucgugaccaccgacaucagcgagaugggcgccaacuucaaggccgaccgcgugaucgacccgcggcgcugccucaagcccgucauccugacggacggccccgagcgggugauccuggccgggcccaugccggugaccgcggccuccgccgcccagcgccggggccgcgucgggcggaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgcgagaaguccgccgccaucgacggcgaguaccggcugaagggcgagucccgcaagacguucguggagcugaugcggcgcggggaccuccccguguggcuggcgcacaaggucgccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcaccuacuccgacccgcuggcccucaaggaguucaaggaguucgccgcgggccgcaagagcaucgcccuggaccuggucacggagaucgggcgcgugcccucccaccucgcccaccggacccgcaacgcccuggacaaccuggugaugcuccacaccagcgagcacggcgggcgggccuaccgccacgcggucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacgcuggccgccaucaucgccgcgaacgagaugggccugcucgagaccaccaagcgcgaccugggcauguccaaggagccgggggucgugagccccaccuccuaccuggacguggaccuccaccccgccagcgccuggacgcuguacgccgucgcgaccaccgugaucacccccaugcugcggcacacgaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugaccgccgccgugcuccugcugaucacgcacuacgccaucaucggccccggccuccaggcgaaggccacccgcgaggcccagaagcggaccgccgccgggaucaugaagaacccgaccguggacggcaucaugacgaucgaccuggaccccgucaucuacgacuccaaguucgagaagcagcugggccaggugaugcuccuggugcugugcgucgugcagcuccugcugaugcgcaccagcugggcgcucugcgaggcccugacccuggccaccggccccaucacgacccucugggagggcucccccgggaaguucuggaacaccaccaucgccgugagcauggcgaacaucuuccggggcuccuaccuggccggggccggccuggccuucagcaucaugaaguccgucgggacgggcaagcgcggcaccgggagccagggcgagacccucggggagaaguggaagaagaagcugaaccagcugagccggaaggacuucgaccucuacaagaaguccggcaucaccgagguggaccgcaccgaggccaaggaggggcugaagcggggcgagaucacgcaccacgcggugagccgcggcuccgccaagcugcagugguucgucgagcggaacauggugaucccggaggggcgcgugaucgaccucggcugcgggcggggcggguggagcuacuacugcgccggccugaagaaggucaccgaggugcgcggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccggguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacgcacgagauguacuggaucuccaacggcaccgggaacaucguggccagcgucaacauggugucccgccuccugcugaaccgguucaccaugacccaccgccggccgacgaucgagaaggacguggaccucggcgccggcacccgccacgucaacgcggagcccgagacccccaacauggacaucaucggggagcggaucaagcgcaucaaggaggagcacaacagcaccuggcacuacgacgacgagaacccguacaagacgugggccuaccacggcuccuacgaggugaaggccaccgggagcgccuccagcaugaucaacggcguggucaagcugcugaccaagcccugggacgugguccccauggugacccagauggccaugacggacaccacccccuucgggcagcagcggguguucaaggagaaggucgacacccgcacgccgcggagcaugcccggcacccgccgggugaugggcaucaccgcggaguggcucuggcgcacccuggggcggaacaagaagccccgccugugcacgcgcgaggaguucaccaagaaggugcggaccaacgccgccaugggcgccgucuucaccgaggagaaccagugggacuccgcgaaggccgccguggaggacgaggacuucuggaagcucgugaacaaggagcgcgagcugcacaagcuggggaagugcggcagcugcgucuacaacaugauggggaagcgggagaagaagcucggcgaguucggcaaggccaaggggucccgcgccaucugguacauguggcugggcgcgcgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacacggccgggugggacacccgcaucaccgaggacgaccugcacaacgaggagaagaucacccagcagauggacccggagcaccggcagcucgcgaacgccaucuucaagcugacguaccagaacaagguggucaaggugcagcgccccacccccaccggcaccgugauggacaucaucagccggaaggaccagcgcggcuccgggcaggucggcaccuacgggcugaacacguucaccaacauggaggcccagcucauccggcagauggagggcgagggggugcugagcaaggccgaccuggagaacccccaccucccggagaagaagaucacccaguggcuggagaccaagggcguggagcgccugaagcggauggccaucuccggcgacgacugcgucgugaagcccaucgacgaccgcuucgcgaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcccggaucagccagggggccggcuggucccucaaggagacggcgugccugggcaaggccuacgcccagauguggagccugauguacuuccaccgccgcgaccuccggcuggccuccaacgcgaucugcagcgccguccccgugcacugggugccgaccucccgcaccaccuggagcauccacgcccaccaccaguggaugacgaccgaggacaugcugaccgucuggaaccggguguggaucgaggacaaccccuggauggaggacaagacccccgugacgaccugggagaacguccccuaccucgggaagcgcgaggaccaguggugcggcagccugaucgggcugaccucccgggccaccugggcccagaacaucccgacggcgauccagcagguccgcagccucaucggcaacgaggaguuccuggacuacaugcccuccaugaagcgguuccgcaaggaggaggagagcgagggggccaucugguga

SEQ ID NO: 10067 - RNA, 9873 nt, Artificial Sequence
  derived and/or modified CDS sequence (opt1) from DENV-3__KF973476__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaucggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgccggcugaccagccgcgagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcggaccgccacccugauccucgccggggugagccugcugccggucugccaguccagcuccaugcgcaagaccgacuggcuccccauggcgguggccgccaugggcgugccgccccucccgcuguucaucuucagccucaaggacacgcugaagcgccgguccuggccccugaacgagggggucauggccgugggccucgugagcauccuggccuccagccugcuccgcaacgacguccccauggcgggcccccugguggccgggggccugcucaucgccugcuacgugaucaccgggaccuccgccgaccugaccgucgagaaggccgcggacaucacgugggaggaggaggccgagcagaccggcgugagccacaaccugaugaucaccguggacgacgacgggaccaugcggaucaaggacgacgagaccgagaacauccucacgguccugcugaagaccgcccuccugaucguguccggcaucuucccguacagcauccccgccacccugcucguguggcacaccuggcagaagcagacgcagcgcuccggcguccugugggacgugcccagcccgcccgagacccagaaggccgagcuggaggaggggguguaccggaucaagcagcagggcaucuucgggaagacccaggucggcgugggggugcagaaggagggcgucuuccacaccauguggcacgugacgcgcggcgcggugcucaccuacaacgggaagcggcuggagcccaacugggccuccgucaagaaggaccugaucagcuacggcgggggcuggcgccucuccgcccaguggcagaagggggaggagguccaggugaucgccgucgagcccggcaagaaccccaagaacuuccagaccaugcccggcaccuuccagacgaccaccggggagaucggcgcgaucgcccuggacuucaagcccgggaccagcggcagccccaucaucaaccggggcgggaagguggugggccuguacgggaacggcgucgugacgaagaacgggggcuacguguccggcaucgcccagaccaacgccgagccggacgggcccacccccgagcuggaggaggagauguucaagaagcgcaaccucaccaucauggaccugcaccccggcagcgggaagacgcggaaguaccugccggccaucguccgcgaggcgaucacccggcgccuccggacccugauccuggcccccacccgcgugguggccgccgagauggaggaggcccucaagggccugcccauccgguaccagacgaccgcgaccaaguccgagcacaccgggcgcgagaucgucgaccugaugugccacgccacguucaccaugcggcuccugagccccgugcgcgugccgaacuacaaccugaucaucauggacgaggcccacuucaccgaccccgccuccaucgccgcgcggggcuacaucagcacccgcgucggcaugggggaggccgccgccaucuucaugacggcgacgccgcccggcaccgccgacgccuucccgcaguccaacgcccccauccaggacgaggagcgcgacauccccgagcggagcuggaacuccgggaacgaguggaucaccgacuucgccggcaagacggugugguucgugcccagcaucaaggcggggaacgacaucgccaacugccuccgcaagaacggcaagaaggucauccagcugucccggaagaccuucgacaccgaguaccagaagaccaagcugaacgacugggacuucguggugacgaccgacaucagcgagaugggcgccaacuucaaggccgaccgcgucaucgacccgcggcgcugccucaagcccgugauccugaccgacgggcccgagcgggugauccuggccggccccaugccggucaccgcggccuccgccgcccagcgccgggggcgcgugggccggaacccccagaaggagaacgaccaguacaucuucaccgggcagccccucaacaacgacgaggaccacgcccacuggacggaggcgaagaugcugcuggacaacaucaacacccccgagggcaucaucccggcccucuucgagcccgagcgcgagaaguccgccgccguggacggcgaguaccggcugaagggggagucccgcaagaccuucgucgagcugaugcggcgcggcgaccuccccguguggcuggcgcacaaggucgccagcgaggggaucaaguacaccgaccggaaguggugcuucgacggccagcgcaacaaccagauccuggaggagaacauggacguggagaucuggacgaaggagggcgagaagaagaagcuccggccccgcuggcuggacgcccgcaccuacuccgacccgcuggcccucaaggaguucaaggaguucgccgcggggcgcaagagcaucgcccuggaccuggugaccgagaucggccgcguccccucccaccucgcccaccggacccgcaacgcccuggacaaccuggugaugcuccacacgagcgagcacgggggccgggccuaccgccacgcgguggaggagcugcccgagaccauggagacccugcuccugcuggggcucaugauccugcugaccggcggcgccaugcuguuccugaucagcgggaagggcaucgggaagacguccaucggccugaucugcgucaucgccagcuccgggaugcucuggauggccgagaucccgcugcaguggaucgccagcgcgaucgugcuggaguucuucaugauggugcuccugauccccgagcccgagaagcagcggacgccccaggacaaccagcuggccuacgucgugaucggcauccucacccuggccgccaucaucgccgcgaacgagaugggccugcucgagaccacgaagcgcgaccuggggauguccaaggagccgggcguggucagccccaccuccuaccuggacguggaccuccaccccgccagcgccuggacccuguacgccguggcgaccacggucaucacccccaugcugcggcacaccaucgagaacuccaccgccaacgugagccucgccgccaucgccaaccaggcggugguccugauggggcuggacaagggcuggccgaucuccaagauggaccucggggugccccugcuggcccucggcugcuacagccaggugaacccccugacgcugaccgccgccguccuccugcugaucacccacuacgccaucaucggccccgggcuccaggcgaaggccacccgcgaggcccagaagcggacggccgccggcaucaugaagaacccgaccguggacgggaucaugaccaucgaccuggaccccgugaucuacgacuccaaguucgagaagcagcugggccaggucaugcuccuggugcugugcgcggugcagcuccugcugaugcgcaccagcugggcccucugcgaggcccugacgcuggccaccggccccaucaccacccucugggaggggucccccggcaaguucuggaacacgaccaucgcggucagcauggccaacaucuuccggggguccuaccuggccggcgccgggcuggccuucagcaucaugaaguccgugggcaccggcaagcgcgggaccggcagccagggggagacccucggcgagaaguggaagcggaagcugaaccagcugagccgcaaggacuucgaccucuacaagaaguccgggaucacggagguggaccggaccgaggcgaaggagggccugaagcgcggcgagaucacccaccacgccgucagccggggguccgccaagcugcagugguucguggagcgcaacauggugaucccggagggccgggucaucgaccucgggugcggccgcgggggcuggagcuacuacugcgccggccugaagaaggugaccgaggugcgcggguacacgaagggcgggcccggccacgaggagcccguccccauguccaccuacggguggaacaucgugaagcugaugagcggcaaggacguguucuaccucccgcccgagaagugcgacacccugcugugcgacaucggcgaguccagccccucccccaccgucgaggagagccggacgauccgcgugcugaagaugguggagccguggcucaagaacaaccaguucugcaucaagguccugaaccccuacaugcccaccgugaucgagcaccuggagcggcuccagcgcaagcacgggggcaugcuggugcggaacccccugucccgcaacagcacccacgagauguacuggaucuccaacgggaccggcaacaucgucgccagcgugaacauggugucccggcuccugcugaaccgcuucacgaugacccaccggcgcccgaccaucgagaaggacgucgaccucggcgcggggacccggcacgugaacgccgagcccgagacgcccaacauggacgugaucggcgagcgcaucaagcggaucaaggaggagcacaacagcaccuggcacuacgacgacgagaacccguacaagaccugggccuaccacggguccuacgaggucaaggccaccggcagcgccuccagcaugaucaacgggguggucaagcugcugacgaagcccugggacguggugcccauggucacccagauggcgaugaccgacaccacgcccuucggccagcagcgcguguucaaggagaagguggacacccggaccccgcgcagcaugcccggcacccggcgcgucauggggaucacggccgaguggcucuggcggacccugggccgcaacaagaagccccgccugugcacccgggaggaguucaccaagaaggugcgcacgaacgccgccaugggggcgguguucaccgaggagaaccagugggacuccgccaaggccgccgucgaggacgaggacuucuggaagcucguggaccgggagcgcgagcugcacaagcugggcaagugcgggagcugcguguacaacaugaugggcaagcgggagaagaagcucggcgaguucgggaaggccaagggcucccgcgcgaucugguacauguggcugggggcccgguaccuggaguucgaggcccucggcuuccugaacgaggaccacugguucagccgcgagaacuccuacagcggggucgagggcgagggccugcacaagcucggguacauccugcgggacaucuccaagauccccggcggggccauguacgccgacgacaccgcgggcugggacacccgcaucacggaggacgaccugcacaacgaggagaagaucacccagcagauggacccggagcaccggcagcucgccaacgccaucuucaagcugaccuaccagaacaagguggugaagguccagcgccccacccccaccggcacggugauggacaucaucagccggaaggaccagcgcggguccggccagguggggaccuacggccugaacaccuucaccaacauggaggcccagcucauccggcagauggagggggagggcguccugagcaaggccgaccuggagaaccccuaccucccggagaagaagaucacgcaguggcuggagaccaagggcguggagcgccugaagcggauggcgaucuccggggacgacugcguggucaagcccaucgacgaccgcuucgccaacgcccuccuggcccugaacgacaugggcaaggugcggaaggacaucccccaguggcagcccagcaagggguggcacgacuggcagcaggucccguucugcucccaccacuuccacgagcucaucaugaaggacggccgcaagcuggucgugcccugccggccccaggacgagcugaucgggcgcgcccgcaucagccagggcgcgggcuggucccucaaggagaccgccugccuggggaaggccuacgcccagauguggagccugauguacuuccaccggcgcgaccuccggcuggcguccaacgccaucugcagcgccgugcccguccacugggugccgaccucccgcacgaccuggagcauccacgcccaccaccaguggaugaccaccgaggacaugcugacgguguggaaccgggucuggaucgaggacaaccccuggauggaggacaagacccccgugaccaccugggagaacgugcccuaccucggcaagcgcgaggaccaguggugcgggagccugaucggccugacgucccgggccaccugggcgcagaacaucccgaccgccauccagcagguccgcagccucaucgggaacgaggaguuccuggacuacaugcccuccaugaagcgguuccgcaaggaggaggagagcgagggcgccaucugguga

SEQ ID NO: 10068 - RNA, 9873 nt, Artificial Sequence
  derived and/or modified CDS sequence (opt1) from DENV-3__KF973478__SS-prME
accagccucugccucaugaugauccugcccgccgcccuggcguuccaccucaccagccgggacggcgagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugcccgaggagcaggaccagaacuacgugugcaagcacaccuacgucgaccggggguggggcaacgggugcggccucuucgggaagggcucccuggugaccugcgccaaguuccagugccuggagcccaucgagggcaaggugguccagcacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugaccucccagcccauggagcugaaguacagcuggaagaccugggggaaggccaagaucgugaccgccgagacgcagaacuccagcuucaucaucgacggcccgaacacccccgagugccccuccgucagccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagucccagaagaacgggagcuggaagcuggagaaggccucccugaucgaggugaagacgugcaccuggcccaagagccacacccucugguccaacggcgugcuggagagcgacaugaucaucccgaagucccuggcggggcccaucagccagcacaaccaccggcccggcuaccacacccagacggccgggccguggcaccucggcaagcuggagcuggacuucaacuacugcgagggcaccaccgucgugaucaccgagaacugcgggacgcgcggccccucccuccggaccaccaccgugagcgggaagcugauccacgaguggugcugccgcuccugcacgcugccgccccuccgguacaugggcgaggacgggugcugguacggcauggagauccgcccgaucagcgagaaggaggagaacauggucaagucccuggugagcgccggcuccgggaagguggacaacuucaccaugggcguccugugccucgccauccuguucgaggaggugaugcgggggaaguucggcaagaagcacaugaucgccgggguguucuucaccuucguccugcuccugagcggccagaucaccuggcgcgacauggcgcacacgcugaucaugaucggcuccaacgccagcgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucucccugaccugcagcaacaccaucuucacccugacggucgccuggcgcaccgccacccugauccucgccggggugucccugcugcccgucugccagagcuccagcaugcggaagaccgacuggcucccgauggcgguggccgccaugggcgugccgccccucccccuguucaucuucgggcucaaggacacgcugaagcgccgcuccuggccgcugaacgagggcgucauggccgugggccucgugagcauccuggccuccagccugcuccggaacgacguccccauggcggggccccugguggccggcgggcugcucaucgccugcuacgugaucaccggcaccuccgccgaccugaccgucgagaaggccgcggacaucacgugggaggaggaggccgagcagaccggggugagccacaaccugaugaucaccguggacgacgacggcaccaugcgcaucaaggacgacgagaccgagaacauccucacgguccugcugaagaccgcccuccugaucguguccggcaucuuccccuacagcaucccggccacccugcucguguggcacaccuggcagaagcagacgcagcgguccgggguccugugggacgugcccuccccgcccgagacccagaaggccgagcuggaggagggcguguaccgcaucaagcagcaggggaucuucggcaagacccaggucggggugggcgugcagaaggagggcgucuuccacaccauguggcacgugacgcgcggggcggugcucaccuacaacggcaagcgccuggagccgaacugggccuccgucaagaaggaccugaucagcuacgggggcggguggcggcucuccgcccaguggcagaagggcgaggagguccaggugaucgccgucgagcccggcaagaaccccaagaacuuccagaccaugcccgggaccuuccagacgaccaccggcgagaucggggcgaucgcccuggacuucaagccgggcaccagcggcagccccaucaucaaccgcgaggggaagguggugggccuguacgggaacggcgucgugacgaagaacgggggcuacguguccggcaucgcccagaccaacgccgagcccgacgggccgacccccgagcuggaggaggagauguucaagaagcggaaccucaccaucauggaccugcaccccggcagcgggaagacgcgcaaguaccugcccgccaucguccgggaggcgaucaagcgccggcuccgcacccugauccuggccccgacccgggugguggccgccgagauggaggaggcccucaagggccugcccauccgcuaccagaccacggcgaccaaguccgagcacaccgggcgggagaucgucgaccugaugugccacgccaccuucacgaugcgccuccugagccccgugcgggugcccaacuacaaccugaucaucauggacgaggcccacuucaccgacccggccuccaucgccgcgcgcggcuacaucagcacccgggucggcaugggggaggccgccgccaucuucaugaccgcgacgccgcccggcaccgccgacgccuucccccaguccaacgccccgauccaggacgaggagcgcgacauccccgagcgcagcuggaacuccgggaacgaguggaucaccgacuucgccggcaagaccgugugguucgugcccagcaucaaggcggggaacgacaucgccaacugccuccggaagaacggcaagaaggucauccagcugucccgcaagacguucgacaccgaguaccagaagaccaagcugaacgacugggacuucguggugaccacggacaucagcgagaugggcgccaacuucaaggccgaccgggucaucgacccccgccggugccucaagccggugauccugaccgacgggcccgagcgcgugauccuggccggccccaugcccgucaccgcggccuccgccgcccagcggcgcgggcgggugggccgcaacccgcagaaggagaacgaccaguacaucuucaccgggcagccccucaacaacgacgaggaccacgcccacuggaccgaggcgaagaugcugcuggacaacaucaacacgcccgagggcaucauccccgcccucuucgagccggagcgggagaaguccgccgccaucgacggcgaguaccgccugaagggggagucccggaagaccuucguggagcugaugcgccggggcgaccuccccgucuggcuggcgcacaagguggccagcgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcacguacuccgacccccuggcccucaaggaguucaaggaguucgccgcggggcgcaagagcaucgcccuggaccuggugaccgagaucggccgggugccgucccaccucgcccaccgcacccggaacgcccuggacaaccuggucaugcuccacaccagcgagcacgggggccgcgccuaccggcacgcgguggaggagcugcccgagacgauggagacccugcuccugcuggggcucaugauccugcugaccggcggcgccaugcuguuccugaucagcgggaagggcaucgggaagaccuccaucggccugaucugcgugaucgccagcuccgggaugcucuggauggccgagaucccccugcaguggaucgccagcgcgaucguccuggaguucuucaugauggugcuccugaucccggagcccgagaagcagcgcacgccccaggacaaccagcuggccuacguggucaucggcauccucacccuggccgccaucaucgccgcgaacgagaugggccugcucgagaccaccaagcgggaccuggggauguccaaggagcccggcguggugagcccgacguccuaccuggacgucgaccuccaccccgccagcgccuggacccuguacgccguggcgaccaccgugaucacgcccaugcugcgccacaccaucgagaacuccaccgccaacgucagccucgccgccaucgccaaccaggcgguggugcugauggggcuggacaagggcuggcccaucuccaagauggaccucggggucccgcugcuggcccucggcugcuacagccaggugaacccccugacccugacggccgccgugcuccugcugaucacccacuacgccaucaucggccccgggcuccaggcgaaggccacccgggaggcccagaagcgcaccgccgccggcaucaugaagaaccccacggucgacgggaucaugaccaucgaccuggacccggugaucuacgacuccaaguucgagaagcagcugggccaggugaugcuccugguccugugcgcggugcagcuccugcugaugcggaccagcugggcccucugcgaggcccugacccuggccacgggccccaucaccacccucugggaggggucccccggcaaguucuggaacaccacgaucgcggugagcauggccaacaucuuccgcggguccuaccuggccggcgccgggcuggccuucagcaucaugaaguccgucggcaccggcaagcgggggaccggcagccagggggagacccucggcgagaaguggaagaagaagcugaaccagcugagccgcaaggacuucgaccucuacaagaaguccgggaucaccgagguggaccggacggaggcgaaggagggccugaagcgcggcgagaucacccaccacgccgugagccggggguccgccaagcugcagugguucgucgagcgcaacauggugauccccgagggccgggugaucgaccucgggugcggccgcgggggcuggagcuacuacugcgccggccugaagaaggucaccgaggugcggggguacaccaagggcgggccgggccacgaggagcccgugcccauguccacguacggguggaacaucgucaagcugaugagcggcaaggacguguucuaccucccgcccgagaagugcgacacccugcugugcgacaucggcgaguccagccccucccccaccguggaggagagccgcaccauccgcguccugaagaugguggagcccuggcucaagaacaaccaguucugcaucaaggugcugaaccccuacaugcccacggucaucgagcaccuggagcggcuccagcgcaagcacgggggcaugcuggugcggaacccccugucccgcaacagcacccacgagauguacuggaucuccaacgggaccggcaacaucguggccagcgucaacauggugucccggcuccugcugaaccgcuucaccaugacgcaccggcgccccaccaucgagaaggacguggaccucggcgcggggacccggcacgucaacgccgagccggagacccccaacauggacgugaucggcgagcgcaucaagcggaucaaggaggagcacaacagcacguggcacuacgacgacgagaaccccuacaagaccugggccuaccacggguccuacgaggugaaggccaccggcagcgccuccagcaugaucaacggggucgugaagcugcugaccaagccgugggacgucgugcccauggugacgcagauggcgaugaccgacaccacccccuucggccagcagcgcgucuucaaggagaagguggacacgcggacgccccggagcaugccgggcacccggcgcgugauggggaucaccgccgaguggcucuggcggacgcugggccgcaacaagaagccccggcugugcacccgcgaggaguucaccaagaagguccgcaccaacgccgccaugggggcgguguucacggaggagaaccagugggacuccgccaaggccgccguggaggacgaggacuucuggaagcucgucgaccgggagcgcgagcugcacaagcugggcaagugcgggagcugcguguacaacaugaugggcaagcgggagaagaagcucggcgaguucgggaaggccaagggcucccgcgcgaucugguacauguggcugggggcccgguaccuggaguucgaggcccucggcuuccugaacgaggaccacugguucagccgcgagaacuccuacagcgggguggagggcgagggccugcaccggcucggguacauccugcgcgacaucuccaagauccccggcggggccauguacgccgacgacaccgcgggcugggacacccggaucaccgaggacgaccugcacaacgaggagaagaucacgcagcagauggaccccgagcaccgccagcucgccaacgccaucuucaagcugaccuaccagaacaaggucgugaaggugcagcggccgacccccaccggcaccgucauggacaucaucagccgcaaggaccagcggggguccggccagguggggacguacggccugaacaccuucaccaacauggaggcccagcucauccgccagauggagggggagggcgugcugagcaaggccgaccuggagaacccccaccuccccgagaagaagaucacccaguggcuggagacgaagggcgucgagcggcugaagcgcauggcgaucuccggggacgacugcguggugaagccgaucgacgaccgguucgccaacgcccuccuggcccugaacgacaugggcaagguccgcaaggacaucccccaguggcagcccagcaagggguggcacgacuggcagcagguccccuucugcucccaccacuuccacgagcucaucaugaaggacggccggaagcugguggucccgugccgcccccaggacgagcugaucgggcgggcccgcaucagccagggcgcgggcuggucccucaaggagaccgccugccuggggaaggccuacgcccagauguggagccugauguacuuccaccgccgggaccuccgccuggcguccaacgccaucugcagcgccgugcccgugcacuggguccccaccucccggaccacguggagcauccacgcccaccaccaguggaugaccaccgaggacaugcugaccguguggaaccgcguguggaucgaggacaacccguggauggaggacaagacgcccgucaccaccugggagaacgugcccuaccucggcaagcgggaggaccaguggugcgggagccugaucggccugaccucccgcgccacgugggcgcagaacauccccaccgccauccagcagguccggagccucaucgggaacgaggaguuccuggacuacaugccguccaugaagcgcuuccggaaggaggaggagagcgagggcgccaucugguga

SEQ ID NO: 10069 - RNA, 9873 nt, Artificial Sequence
  derived and/or modified CDS sequence (opt1) from DENV-3__KF973479__SS-prME
accagccugugccucaugaugauccugcccgccgcccuggcguuccaccucaccagccgggacggcgagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaaccugggcgggaccagcaucuucgccggccaccugaagugccggcucaagauggacaagcuggagcugaagggcauguccuacgccaugugcacgaacaccuucgugcucaagaaggaggucagcgagacccagcacgggaccauccugaucaagguggaguacaagggcgaggacgcgccgugcaagauccccuucuccacggaggacgggcagggcaaggcccacaacggccgccugaucaccgccaaccccguggucaccaagaaggaggagcccgugaacaucgaggccgagccgcccuucggggagagcaacaucgugaucggcaucggggacaacgcgcugaagaucaacugguacaagaagggcagcuccaucgggaagauguucgaggccaccgcccggggcgcccgccggauggccauccucggcgacacggcgugggacuucgggagcgucggcggggugcugaacucccugggcaagauggugcaccagaucuucgggagcgccuacaccgcccucuucuccggcgucagcugggugaugaagaucggcaucggggugcugcugaccuggaucggccucaacuccaagaacaccagcauguccuucagcugcaucgccaucgggaucaucacgcuguaccugggcgccgucgugcaggcggacauggggugcgugaucaacuggaagggcaaggagcucaagugcggcuccgggaucuucgucaccaacgaggugcacaccuggaccgagcaguacaaguuccaggccgacagccccaagcgccuggccacggccaucgccggcgcgugggagaacggggugugcggcauccgcuccaccacccggauggagaaccugcucuggaagcagaucgccaacgagcugaacuacauccugugggagaacaacaucaagcucaccgucguggugggggacaucaucggcguccuggagcagggcaagcgcacgcugacgccccagccgauggagcucaaguacagcuggaagaccugggggaaggccaagaucgugaccgccgagacgcagaacuccagcuucaucaucgacggccccaacacccccgagugccccuccgugagccgggcguggaacgucugggagguggaggacuacggguucggcguguucaccaccaacaucuggcugaagcugcgcgaggucuacacccagcucugcgaccaccggcugauguccgccgccgugaaggacgagcgcgccgugcacgccgacaugggcuacuggaucgagagccagaagaacgggagcuggaagcuggagaaggcgucccucaucgaggucaagacgugcaccuggcccaagagccacacccugugguccaacggcgugcuggagagcgacaugaucauccccaagucccucgccgggcccaucagccagcacaaccaccggccgggcuaccacacccagacggccgggcccuggcaccugggcaagcuggagcucgacuucaacuacugcgagggcaccaccguggucaucaccgagaacugcgggacgcgcggccccucccugcggaccaccaccgugagcgggaagcugauccacgaguggugcugccgcuccugcacgcugccgccccugcgguacaugggcgaggacgggugcugguacggcauggagauccgccccaucagcgagaaggaggagaacauggugaagucccuggucagcgccggcuccgggaagguggacaacuucaccaugggcgugcucugccuggccauccuguucgaggaggucaugcgggggaaguucggcaagaagcacaugaucgcggggguguucuucaccuucgugcuccugcugagcggccagaucaccuggcgcgacauggcccacacgcucaucaugaucggcuccagcgccuccgaccggauggggaugggcgucaccuaccuggcccugaucgccaccuucaagauccagcccuuccucgcgcugggguucuuccugcgcaagcucaccagccgggagaaccugcugcucggcgugggccuggccauggccacgacccugcagcuccccgaggacaucgagcagauggccaacgggaucgcgcugggccugauggcccucaagcugaucacccaguucgagaccuaccagcuguggacggcccucaucagccugaccugcuccaacaccaucuucacccugacgguggccuggcgcaccgccacccucauccuggcgggggucagccugcuccccgugugccaguccagcuccaugcggaagaccgacuggcugcccauggccgucgccgccaugggcgugccgccccucccccuguucaucuucgggcugaaggacacgcugaagcgccgcagcuggccccucaacgagggcgugauggccgucggccugguguccauccuggcgagcucccuccugcggaacgacgugcccauggccgggccccuggucgccggcgggcuccugaucgccugcuacgugaucaccggcaccagcgccgaccugaccguggagaaggcggccgacaucacgugggaggaggaggccgagcagaccggggucucccacaaccucaugaucaccguggacgacgacggcaccaugcgcaucaaggacgacgagaccgagaacauccugacggugcugcucaagaccgcccugcugaucgucagcggcaucuucccguacuccauccccgccacccuccugguguggcacaccuggcagaagcagacgcagcggagcggggugcugugggacguccccagcccgcccgagacccagaaggcggagcucgaggagggcguguaccgcaucaagcagcaggggaucuucggcaagacccaggugggggucggcgugcagaaggagggcguguuccacaccauguggcacgucacgcgcggggccgugcugaccuacaacggcaagcgccuggagcccaacugggccagcgugaagaaggaccucaucuccuacgggggcggguggcggcugagcgcccaguggcagaagggcgaggagguccaggugaucgcgguggagcccggcaagaaccccaagaacuuccagaccaugccggggaccuuccagacgaccaccggcgagaucggggccaucgcccuggacuucaagcccggcaccuccggcagccccaucaucaaccgcgaggggaaggucgugggccuguacgggaacggcguggucacgaagaacgggggcuacgugagcggcaucgcccagaccaacgccgagccggacgggcccacccccgagcucgaggaggagauguucaagaagcggaaccugaccaucauggaccugcaccccggcuccgggaagacgcgcaaguaccucccggcgaucgugcgggaggccaucaagcgccggcugcgcacccugauccucgcccccacccgggucguggccgccgagauggaggaggcgcugaagggccugcccauccgcuaccagaccacggccaccaagagcgagcacaccgggcgggagaucguggaccucaugugccacgccaccuucacgaugcgccugcugucccccguccgggugccgaacuacaaccucaucaucauggacgaggcccacuucaccgaccccgccagcaucgcggcccgcggcuacaucuccacccgggugggcaugggggaggccgccgcgaucuucaugaccgccacgccgcccggcaccgccgacgccuucccgcagagcaacgcccccauccaggacgaggagcgcgacauccccgagcgcuccuggaacagcgggaacgaguggaucaccgacuucgcgggcaagaccgucugguucgugcccuccaucaaggccgggaacgacaucgccaacugccugcggaagaacggcaagaaggugauccagcugagccgcaagacguucgacaccgaguaccagaagaccaagcucaacgacugggacuucgucgugaccacggacaucuccgagaugggcgccaacuucaaggccgaccgggugaucgacccgcgccggugccugaagcccgucauccugaccgacgggcccgagcgcgugauccucgcgggccccaugccggugaccgccgccagcgccgcccagcggcgcgggcgggucggccgcaacccccagaaggagaacgaccaguacaucuucaccgggcagccccugaacaacgacgaggaccacgcgcacuggaccgaggccaagaugcugcucgacaacaucaacacgcccgagggcaucaucccggcccuguucgagcccgagcgggagaaguccgccgcgaucgacggcgaguaccgccugaagggggagagccggaagaccuucguggagcucaugcgccggggcgaccugcccguguggcuggcccacaaggucgccuccgaggggaucaaguacaccgaccgcaaguggugcuucgacggccagcggaacaaccagauccucgaggagaacauggacguggagaucuggaccaaggagggcgagaagaagaagcugcgcccccgguggcuggacgcccgcacguacagcgacccgcucgcccugaaggaguucaaggaguucgcggccgggcgcaaguccaucgcccuggaccucgucaccgagaucggccgggugcccagccaccuggcccaccgcacccggaacgcccuggacaaccucgugaugcugcacaccuccgagcacgggggccgcgcguaccggcacgccgucgaggagcugcccgagacgauggagacccuccugcugcucgggcugaugauccugcucaccggcggcgccaugcuguuccugaucagcgggaagggcaucgggaagaccagcaucggccucaucugcgugaucgccuccagcgggaugcuguggauggccgagaucccgcugcaguggaucgcguccgccaucgugcucgaguucuucaugaugguccugcugauccccgagcccgagaagcagcgcacgccccaggacaaccagcucgccuacguggugaucggcauccugacccuggccgccaucaucgcggccaacgagaugggccuccuggagaccaccaagcgggaccuggggaugagcaaggagccgggcgucgugucccccacgagcuaccucgacguggaccugcaccccgccuccgccuggacccuguacgcggucgccaccaccgugaucacgcccaugcuccgccacaccaucgagaacagcaccgccaacgugucccuggccgccaucgcgaaccaggccgucgugcugauggggcucgacaagggcuggccgaucagcaagauggaccugggggugccccugcucgcccugggcugcuacucccaggucaacccccugacccucacggccgccgugcugcugcucaucacccacuacgcgaucaucggccccgggcugcaggccaaggccacccgggaggcccagaagcgcaccgccgcgggcaucaugaagaacccgacgguggacgggaucaugaccaucgaccuggaccccgucaucuacgacagcaaguucgagaagcagcucggccaggugaugcugcuggugcucugcgccguccagcugcugcucaugcggaccuccugggcccugugcgaggcccugacccucgcgacgggccccaucaccacccugugggaggggagccccggcaaguucuggaacaccacgaucgccguguccauggccaacaucuuccgcgggagcuaccuggccggcgccgggcucgcguucuccaucaugaaguccgugggcaccggcaagcgggggaccggcucccagggggagacccugggcgagaaguggaagaagaagcugaaccagcucagccgcaaggacuucgaccuguacaagaaguccgggaucaccgaggucgaccggacggaggccaaggagggccugaagcgcggcgagaucacccaccacgccgugucccgggggagcgccaagcuccagugguucguggagcgcaacauggucaucccggagggccgggugaucgaccuggggugcggccgcgggggcugguccuacuacugcgccggccugaagaaggugaccgagguccggggguacaccaagggcgggcccggccacgaggagcccgugcccaugagcacguacggguggaacaucgugaagcucauguccggcaaggacgucuucuaccugccgcccgagaagugcgacacccugcugugcgacaucggcgagagcucccccagccccaccguggaggagucccgcaccauccgcgugcucaagauggucgagccguggcugaagaacaaccaguucugcaucaaggugcugaaccccuacaugcccacggugaucgagcaccucgagcggcugcagcgcaagcacgggggcaugcugguccggaacccccucagccgcaacuccacccacgagauguacuggaucagcaacgggaccggcaacaucguggcguccgugaacauggucagccggcugcugcucaaccgcuucaccaugacgcaccggcgcccgaccaucgagaaggacguggaccugggcgccgggacccggcacgugaacgccgagcccgagacccccaacauggacgucaucggcgagcgcaucaagcggaucaaggaggagcacaacuccacguggcacuacgacgacgagaacccguacaagaccugggccuaccacgggagcuacgaggugaaggccaccggcuccgcgagcuccaugaucaacgggguggucaagcugcucaccaagcccugggacgugguccccauggugacgcagauggccaugaccgacaccacccccuucggccagcagcgcguguucaaggagaaggucgacacgcggaccccgcgcagcaugcccggcacccggcgcgugauggggaucaccgccgaguggcuguggcggacgcugggccgcaacaagaagccccggcucugcacccgcgaggaguucaccaagaaggugcgcaccaacgccgcgaugggggccgucuucacggaggagaaccagugggacagcgccaaggccgccguggaggacgaggacuucuggaagcugguggaccgggagcgcgagcugcacaagcucggcaagugcggguccugcgucuacaacaugaugggcaagcgggagaagaagcugggcgaguucgggaaggcgaagggcagccgcgccaucugguacauguggcugggggcccgguaccucgaguucgaggcccugggcuuccugaacgaggaccacugguucucccgcgagaacagcuacuccgggguggagggcgagggccuccacaagcugggguacauccugcgggacaucagcaagauccccggcggggccauguacgcggacgacaccgccggcugggacacccgcaucaccgaggacgaccuccacaacgaggagaagaucacgcagcagauggacccggagcaccggcagcuggccaacgccaucuucaagcugaccuaccagaacaagguggucaaggugcagcgccccacccccaccggcaccgugauggacaucaucucccggaaggaccagcgcgggagcggccaggucgggacguacggccucaacaccuucaccaacauggaggcccagcugauccggcagauggagggggagggcgugcuguccaaggcggaccucgagaacccccaccucccggagaagaagaucacccaguggcuggagacgaagggcguggagcgccucaagcggauggccaucagcggggacgacugcgucgugaagcccaucgacgaccgcuucgccaacgcccugcuggcccucaacgacaugggcaaggugcggaaggacaucccccaguggcagcccuccaagggguggcacgacuggcagcaggucccguucugcagccaccacuuccacgagcugaucaugaaggacggccgcaagcugguggugcccugccggccccaggacgagcucaucgggcgcgcgcggaucucccagggcgccggcuggagccugaaggagaccgccugccuggggaaggccuacgcgcagauguggucccucauguacuuccaccgccgcgaccugcggcuggccagcaacgccaucugcuccgccguccccgugcacugggugccgaccagccgcaccacgugguccauccacgcccaccaccaguggaugaccaccgaggacaugcucaccgucuggaaccggguguggaucgaggacaaccccuggauggaggacaagacgcccgugaccaccugggagaacguccccuaccugggcaagcgcgaggaccaguggugcgggagccugaucggccucaccagccgggcgacgugggcccagaacaucccgaccgccauccagcagguccgcucccugaucgggaacgaggaguuccuggacuacaugcccagcaugaagcgguuccgcaaggaggaggaguccgagggcgccaucugguga

SEQ ID NO: 10070 - RNA, 9873 nt, Artificial Sequence
  derived and/or modified CDS sequence (opt1) from DENV-3__KF973480__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagaccugggcccugcgccacccgggguucaccauccucgcgcuguuccuggcccacuacaucggcaccucccucacccagaagguggugaucuucacgcugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggcgacccuccggaagcugugcaucgagggcaagaucaccaacaucaccacggacagccgcugccccacccagggcgaggccacccugccggaggagcaggaccagaacuacgugugcaagcacaccuacgucgaccggggguggggcaacgggugcggccucuucgggaagggcucccuggugacgugcgccaaguuccagugccuggagcccaucgagggcaaggugguccaguacgagaaccucaaguacaccgugaucaucaccgugcacaccggggaccagcaccaggucggcaacgagacgcagggggugaccgccgagaucacgccccaggccagcaccaccgaggcgauccugcccgaguacggcacgcuggggcucgagugcuccccgcgcaccggccuggacuucaacgagaugauccugcucaccaugaagaacaaggccuggaugguccaccggcagugguucuucgaccugccccugcccuggaccagcggcgccacgaccgagacccccaccuggaaccgcaaggagcuccuggugacguucaagaacgcccacgccaagaagcaggagguggucgugcuggggucccaggagggcgcgaugcacaccgcccucaccggggccaccgagauccagaacagcggcgggacguccaucuucgccggccaccugaagugccggcugaagauggacaagcucgagcugaagggcaugagcuacgccaugugcaccaacaccuucgugcugaagaaggaggucuccgagacccagcacgggacgauccucaucaagguggaguacaagggcgaggacgugccgugcaagauccccuucagcaccgaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagaucuucgaggcgacggcccggggcgcccgccggauggccauccugggcgacaccgccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacacguccaugagcuucuccugcaucgccaucgggaucaucacccucuaccugggcgccguggugcaggccgacauggggugcgucaucaacuggaagggcaaggagcugaagugcggcagcgggaucuucgugaccaacgaggugcacaccuggacggagcaguacaaguuccaggcggacucccccaagcgccucgccaccgccaucgccggcgccugggagaacggggucugcggcauccgcagcaccacccggauggagaaccugcuguggaagcagaucgcgaacgagcucaacuacauccugugggagaacaacaucaagcugacggugguggucggggacaucaucggcgugcucgagcagggcaagcgcacccugacgccccagccgauggagcugaaguacuccuggaagaccugggggaaggccaagaucgugacggccgagacccagaacagcuccuucaucaucgacggccccaacacccccgagugccccagcgucucccgggccuggaacgugugggagguggaggacuacggguucggcgucuucaccaccaacaucuggcucaagcugcgcgagguguacacgcagcugugcgaccaccggcucaugagcgcggccgugaaggacgagcgcgccguccacgccgacaugggcuacuggaucgagagccagaagaacggguccuggaagcuggagaaggccagccugaucgaggugaagaccugcaccuggccgaagucccacacccucuggagcaacggcgugcuggaguccgacaugaucauccccaagagccuggcggggcccaucucccagcacaaccaccggccgggcuaccacacgcagaccgccgggcccuggcaccucggcaagcuggagcuggacuucaacuacugcgagggcaccaccgucgugaucacggagaacugcgggacccgcggccccagccuccggaccaccacgguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucgcgcugcuccuguccggccagaucacguggcgcgacauggcccacacccugaucaugaucggcagcaacgccuccgaccggauggggaugggcgucaccuaccucgcccugaucgccaccuucaagauccagcccuuccuggcgcucggguucuuccugcgcaagcugacgagccgggagaaccuccugcugggcgugggccucgccauggccaccacccugcagcugcccgaggacaucgagcagauggccaacgggaucgcgcucggccugauggcccugaagcucaucacccaguucgagacguaccagcuguggaccgcccugaucagccugaccugcuccaacaccaucuucacgcugaccguggccuggcgcaccgccacccugauccucgcgggggucagccugcugccggugugccaguccagcuccaugcggaagacggacuggcuccccauggccgucgccgccaugggcgugccgccccucccgcuguucaucuucgggcucaaggacacccugaagcgccgcagcuggccccugaacgagggcgugauggccgucggccucguguccauccuggcgagcucccugcuccggaacgacgugcccauggccgggccccuggucgccggcgggcugcucaucgccugcuacgugaucaccggcaccagcgccgaccugacgguggagaaggcggccgacaucaccugggaggaggaggccgagcagaccggggucucccacaaccugaugaucaccguggacgacgacggcaccaugcgcaucaaggacgacgagacggagaacauccucaccgugcugcugaagaccgcccuccugaucgucagcggcaucuucccguacuccauccccgccacccugcucguguggcacacguggcagaagcagacccagcggagcggggugcugugggacguccccagcccgcccgagacccagaaggcggagcuggaggagggcguguaccgcaucaagcagcaggggaucuucggcaagacccaggugggggucggcgugcagaaggagggcguguuccacacgauguggcacgucacccgcggggccgugcucaccuacaacggcaagcgccuggagcccaacugggccagcgugaagaaggaccugaucuccuacgggggcggguggcggcucagcgcccaguggcagaagggcgaggagguccaggugaucgcgguggagcccggcaagaaccccaagaacuuccagaccaugcccgggacguuccagaccaccaccggcgagaucggggccaucgcccuggacuucaagcccggcacguccggcagccccaucaucaaccgcgaggggaaggucgugggccuguacgggaacggcguggucaccaagaacgggggcuacgugagcggcaucgcccagaccaacgccgagccggacgggcccacccccgagcuggaggaggagauguucaagaagcggaaccucacgaucauggaccugcaccccggcuccgggaagacccgcaaguaccugccggcgaucgugcgggaggccaucaagcgccggcuccgcacccugauccuggcccccacccgggucguggccgccgagauggaggaggcgcucaagggccugcccauccgcuaccagacgaccgccaccaagagcgagcacaccgggcgggagaucguggaccugaugugccacgccacguucaccaugcgccuccugucccccguccgggugccgaacuacaaccugaucaucauggacgaggcccacuucaccgaccccgccagcaucgcggcccgcggcuacaucuccacccgggugggcaugggggaggccgccgcgaucuucaugacggccacgccgcccggcaccgccgacgccuucccgcagagcaacgcccccauccaggacgaggagcgcgacauccccgagcgcuccuggaacagcgggaacgaguggaucaccgacuucgcgggcaagacggucugguucgugcccuccaucaaggccgggaacgacaucgccaacugccuccggaagaacggcaagaaggugauccagcugagccgcaagaccuucgacaccgaguaccagaagaccaagcugaacgacugggacuucgucgugacgaccgacaucuccgagaugggcgccaacuucaaggccgaccgggugaucgacccgcgccggugccucaagcccgucauccugaccgacgggcccgagcgcgugauccuggcgggccccaugccggugaccgccgccagcgccgcccagcggcgcgggcgggucggccgcaacccccagaaggagaacgaccaguacaucuucaccgggcagccccucaacaacgacgaggaccacgcgcacuggacggaggccaagaugcugcuggacaacaucaacacccccgagggcaucaucccggcccucuucgagcccgagcgggagaaguccgccgcgaucgacggcgaguaccgccugaagggggagagccggaagaccuucguggagcugaugcgccggggcgaccuccccguguggcuggcccacaaggucgccuccgaggggaucaaguacaccgaccgcaaguggugcuucgacggccagcggaacaaccagauccuggaggagaacauggacguggagaucuggacgaaggagggcgagaagaagaagcuccgcccccgguggcuggacgcccgcaccuacagcgacccgcuggcccucaaggaguucaaggaguucgcggccgggcgcaaguccaucgcccuggaccuggucaccgagaucggccgggugcccagccaccucgcccaccgcacccggaacgcccuggacaaccuggugaugcuccacacguccgagcacgggggccgcgcguaccggcacgccgucgaggagcugcccgagaccauggagacccugcuccugcuggggcucaugauccugcugaccggcggcgccaugcuguuccugaucagcgggaagggcaucgggaagacgagcaucggccugaucugcgugaucgccuccagcgggaugcucuggauggccgagaucccgcugcaguggaucgcguccgccaucgugcuggaguucuucaugaugguccuccugauccccgagcccgagaagcagcgcacgccccaggacaaccagcuggccuacguggugaucggcauccucacccuggccgccaucaucgcggccaacgagaugggccugcucgagaccacgaagcgggaccuggggaugagcaaggagccgggcgucgugucccccaccagcuaccuggacguggaccuccaccccgccuccgccuggacccuguacgcggucgccaccacggugaucacccccaugcugcgccacaccaucgagaacagcaccgccaacgugucccucgccgccaucgcgaaccaggccgucgugcugauggggcuggacaagggcuggccgaucagcaagauggaccucggggugccccugcuggcccucggcugcuacucccaggucaacccccugacgcugaccgccgccgugcuccugcugaucacccacuacgcgaucaucggccccgggcuccaggccaaggccacccgggaggcccagaagcgcacggccgcgggcaucaugaagaacccgaccguggacgggaucaugaccaucgaccuggaccccgucaucuacgacagcaaguucgagaagcagcugggccaggugaugcuccuggugcugugcgccguccagcuccugcugaugcggaccuccugggcccucugcgaggcccugacgcuggcgaccggccccaucaccacccucugggaggggagccccggcaaguucuggaacacgaccaucgccguguccauggccaacaucuuccgcgggagcuaccuggccggcgccgggcuggcguucuccaucaugaaguccgugggcaccggcaagcgggggaccggcucccagggggagacccucggcgagaaguggaagaagaagcugaaccagcugagccgcaaggacuucgaccucuacaagaaguccgggaucacggaggucgaccggaccgaggccaaggagggccugaagcgcggcgagaucacccaccacgccgugucccgggggagcgccaagcugcagugguucguggagcgcaacauggucaucccggagggccgggugaucgaccucgggugcggccgcgggggcugguccuacuacugcgccggccugaagaaggugaccgagguccggggguacacgaagggcgggcccggccacgaggagcccgugcccaugagcaccuacggguggaacaucgugaagcugauguccggcaaggacgucuucuaccucccgcccgagaagugcgacacccugcugugcgacaucggcgagagcucccccagccccaccguggaggagucccgcacgauccgcgugcugaagauggucgagccguggcucaagaacaaccaguucugcaucaaggugcugaaccccuacaugcccaccgugaucgagcaccuggagcggcuccagcgcaagcacgggggcaugcugguccggaacccccugagccgcaacuccacccacgagauguacuggaucagcaacgggaccggcaacaucguggcguccgugaacauggucagccggcuccugcugaaccgcuucacgaugacccaccggcgcccgaccaucgagaaggacguggaccucggcgccgggacccggcacgugaacgccgagcccgagacgcccaacauggacgucaucggcgagcgcaucaagcggaucaaggaggagcacaacuccaccuggcacuacgacgacgagaacccguacaagaccugggccuaccacgggagcuacgaggugaaggccaccggcuccgcgagcuccaugaucaacgggguggucaagcugcugacgaagcccugggacgugguccccauggugacccagauggccaugaccgacaccacgcccuucggccagcagcgcguguucaaggagaaggucgacacccggaccccgcgcagcaugcccggcacccggcgcgugauggggaucacggccgaguggcucuggcggacccugggccgcaacaagaagccccggcugugcacccgcgaggaguucaccaagaaggugcgcacgaacgccgcgaugggggccgucuucaccgaggagaaccagugggacagcgccaaggccgccguggaggacgaggacuucuggaagcucguggaccgggagcgcgagcugcacaagcugggcaagugcggguccugcgucuacaacaugaugggcaagcgggagaagaagcucggcgaguucgggaaggcgaagggcagccgcgccaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgcggacgacaccgccggcugggacacccgcaucacggaggacgaccugcacaacgaggagaagaucacccagcagauggacccggagcaccggcagcucgccaacgccaucuucaagcugaccuaccagaacaagguggucaaggugcagcgccccacccccaccggcacggugauggacaucaucucccggaaggaccagcgcgggagcggccaggucgggaccuacggccugaacaccuucaccaacauggaggcccagcucauccggcagauggagggggagggcgugcuguccaaggcggaccuggagaacccccaccucccggagaagaagaucacgcaguggcuggagaccaagggcguggagcgccugaagcggauggccaucagcggggacgacugcgucgugaagcccaucgacgaccgcuucgccaacgcccuccuggcccugaacgacaugggcaaggugcggaaggacaucccccaguggcagcccuccaagggguggcacgacuggcagcaggucccguucugcagccaccacuuccacgagcucaucaugaaggacggccgcaagcugguggugcccugccggccccaggacgagcugaucgggcgcgcgcggaucucccagggcgccggcuggagccucaaggagaccgccugccuggggaaggccuacgcgcagauguggucccugauguacuuccaccgccgcgaccuccggcuggccagcaacgccaucugcuccgccguccccgugcacugggugccgaccagccgcacgaccugguccauccacgcccaccaccaguggaugaccaccgaggacaugcugacggucuggaaccggguguggaucgaggacaaccccuggauggaggacaagacccccgugaccaccugggagaacguccccuaccucggcaagcgcgaggaccaguggugcgggagccugaucggccugacgagccgggcgaccugggcccagaacaucccgaccgccauccagcagguccgcucccucaucgggaacgaggaguuccuggacuacaugcccagcaugaagcgguuccgcaaggaggaggaguccgagggcgccaucugguga

SEQ ID NO: 10071 - RNA, 9873 nt, Artificial Sequence
  derived and/or modified CDS sequence (opt1) from DENV-3__KF973481__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgugacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacgaucaucaucaccgugcacaccggggaccagcaccaggugggcaacgagacccagggggucacggccgagaucacgccccaggccagcaccaccgaggcgauccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggucaccuucaagaacgcccacgccaagaagcaggagguggugguccuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggagguguccgagacccagcacgggaccauccucaucaaggucgaguacaagggcgaggacgugccgugcaagauccccuucagcacggaggacgggcagggcaaggcgcacaacggccgccugaucaccgccaaccccguggucaccaagaaggaggagcccgugaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacacggccugggacuucggguccgucggcggggugcucaacagccugggcaagauggugcaccagaucuucggguccgcguacaccgcccuguucagcggcgucuccugggugaugaagaucggcaucggggugcuccugaccuggaucggccugaacagcaagaacaccuccaugagcuucuccugcaucgccaucgggaucaucacgcucuaccugggcgccgucgugcaggccgacauggggugcgugaucaacuggaagggcaaggagcugaagugcggcagcgggaucuucgucaccaacgaggugcacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccgucguggugggggacaucaucggcguccucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgugucccgggccuggaacgucugggagguggaggacuacggguucggcguguucaccaccaacaucuggcucaagcugcgcgaggucuacacccagcugugcgaccaccggcucaugagcgcggccgugaaggacgagcgcgccgugcacgccgacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccguggucaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccuggucuccgccggcagcgggaagguggacaacuucaccgugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucgggcucaaggacacgcugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugaccgucgagaaggccgcggacaucacgugggaggaggaggccgagcagaccggggugucccacaaccugaugaucaccguggacgacgacggcaccaugcgcaucaaggacgacgagaccgagaacauccucacgguccugcugaagaccgcccuccugaucgugagcggcaucuucccguacuccauccccgccacccugcucguguggcacaccuggcagaagcagacgcagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacaccauguggcacgugacgcgcggggcggugcucaccuacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggaccuuccagacgaccaccggcgagaucggggcgaucgcccuggacuucaagcccggcaccuccggcagccccaucaucaaccgcgaggggaagguggugggccuguacgggaacggcgucgugacgaagaacgggggcuacgugagcggcaucgcccagaccaacgccgagccggacgggcccacccccgagcuggaggaggagauguucaagaagcggaaccucaccaucauggaccugcaccccggcuccgggaagacgcgcaaguaccugccggccaucguccgggaggcgaucaagcgccggcuccgcacccugauccuggcccccacccgggugguggccgccgagauggaggaggcccucaagggccugcccauccgcuaccagaccacggcgaccaagagcgagcacaccgggcgggagaucgucgaccugaugugccacgccaccuucacgaugcgccuccugucccccgugcgggugccgaacuacaaccugaucaucauggacgaggcccacuucaccgaccccgccagcaucgccgcgcgcggcuacaucuccacccgggucggcaugggggaggccgccgccaucuucaugaccgcgacgccgcccggcaccgccgacgccuucccgcagagcaacgcccccauccaggacgaggagcgcgacauccccgagcgcuccuggaacagcgggaacgaguggaucaccgacuucgccggcaagaccgugugguucgugcccuccaucaaggcggggaacgacaucgccaacugccuccggaagaacggcaagaaggucauccagcugagccgcaagacguucgacaccgaguaccagaagaccaagcugaacgacugggacuucguggugaccacggacaucuccgagaugggcgccaacuucaaggccgaccgggucaucgacccgcgccggugccucaagcccgugauccugaccgacgggcccgagcgcgugauccuggccggccccaugccggucaccgcggccagcgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacgcccgagggcaucaucccggcccucuucgagcccgagcgggagaaguccgccgccaucgacggcgaguaccgccugaagggggagagccggaagaccuucguggagcugaugcgccggggcgaccuccccgucuggcuggcgcacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcacguacagcgacccgcuggcccucaaggaguucaaggaguucgccgcggggcgcaaguccaucgcccuggaccuggugaccgagaucggccgggugcccagccaccucgcccaccgcacccggaacgcccuggacaaccuggucaugcuccacaccuccgagcacgggggccgcgccuaccggcacgcgguggaggagcugcccgagacgauggagacccugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgccuccgcgaucguccuggaguucuucaugauggugcuccugauccccgagcccgagaagcagcgcacgccccaggacaaccagcuggccuacguggucaucggcauccucacccuggccgccaucaucgccgcgaacgagaugggccugcucgagaccaccaagcgggaccuggggaugagcaaggagccgggcguggugucccccacgagcuaccuggacgucgaccuccaccccgccuccgccuggacccuguacgccguggcgaccaccgugaucacgcccaugcugcgccacaccaucgagaacagcaccgccaacgucucccucgccgccaucgccaaccaggcgguggugcugauggggcuggacaagggcuggccgaucagcaagauggaccucggggucccccugcuggcccucggcugcuacucccaggugaacccccugacccugacggccgccgugcuccugcugaucacccacuacgccaucaucggccccgggcuccaggcgaaggccacccgggaggcccagaagcgcaccgccgccggcaucaugaagaacccgacggucgacgggaucaugaccaucgaccuggaccccgugaucuacgacagcaaguucgagaagcagcugggccaggugaugcuccugguccugugcgcggugcagcuccugcugaugcggaccuccugggcccucugcgaggcccugacccuggccacgggccccaucaccacccucugggaggggagccccggcaaguucuggaacaccacgaucgcgguguccauggccaacaucuuccgcgggagcuaccuggccggcgccgggcuggccuucuccaucaugaaguccgucggcaccggcaagcgggggaccggcucccagggggagacccucggcgagaaguggaagaagaagcugaaccagcugagccgcaaggacuucgaccucuacaagaaguccgggaucaccgagguggaccggacggaggcgaaggagggccugaagcgcggcgagaucacccaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacaccaagggcgggcccggccacgaggagcccgugcccaugagcacguacggguggaacaucgucaagcugauguccggcaaggacguguucuaccucccgcccgagaagugcgacacccugcugugcgacaucggcgagagcucccccagccccaccguggaggagucccgcaccauccgcguccugaagaugguggagccguggcucaagaacaaccaguucugcaucaaggugcugaaccccuacaugcccacggucaucgagcaccuggagcggcuccagcgcaagcacgggggcaugcuggugcggaacccccugagccgcaacuccacccacgagauguacuggaucagcaacgggaccggcaacaucguggccuccgucaacauggugagccggcuccugcugaaccgcuucaccaugacgcaccggcgcccgaccaucgagaaggacguggaccucggcgcggggacccggcacgucaacgccgagcccgagacccccaacauggacgugaucggcgagcgcaucaagcggaucaaggaggagcacaacuccacguggcacuacgacgacgagaacccguacaagaccugggccuaccacgggagcuacgaggugaaggccaccggcuccgccagcuccaugaucaacggggucgugaagcugcugaccaagcccugggacgucgugcccauggugacgcagauggcgaugaccgacaccacccccuucggccagcagcgcgucuucaaggagaagguggacacgcggaccccgcgcagcaugcccggcacccggcgcgugauggggaucaccgccgaguggcucuggcggacgcugggccgcaacaagaagccccggcugugcacccgcgaggaguucaccaagaagguccgcaccaacgccgccaugggggcgguguucacggaggagaaccagugggacagcgccaaggccgccguggaggacgaggacuucuggaagcucgucgaccgggagcgcgagcugcacaagcugggcaagugcggguccugcguguacaacaugaugggcaagcgggagaagaagcucggcgaguucgggaaggccaagggcagccgcgcgaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgccgacgacaccgcgggcugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucucccggaaggaccagcgcgggagcggccagguggggacguacggccugaacaccuucaccaacauggaggcccagcucauccggcagauggagggggagggcgugcuguccaaggccgaccuggagaacccccaccucccggagaagaagaucacccaguggcuggagacgaagggcgucgagcgccugaagcggauggcgaucagcggggacgacugcguggugaagcccaucgacgaccgcuucgccaacgcccuccuggcccugaacgacaugggcaagguccggaaggacaucccccaguggcagcccuccaagggguggcacgacuggcagcaggucccguucugcagccaccacuuccacgagcucaucaugaaggacggccgcaagcuggugguccccugccggccccaggacgagcugaucgggcgcgcccggaucucccagggcgcgggcuggagccucaaggagaccgccugccuggggaaggccuacgcccagauguggucccugauguacuuccaccgccgcgaccuccggcuggcgagcaacgccaucugcuccgccgugcccgugcacugggucccgaccagccgcaccacgugguccauccacgcccaccaccaguggaugaccaccgaggacaugcugaccguguggaaccggguguggaucgaggacaaccccuggauggaggacaagacgcccgucaccaccugggagaacgugcccuaccucggcaagcgcgaggaccaguggugcgggagccugaucggccugaccagccgggccacgugggcgcagaacaucccgaccgccauccagcagguccgcucccucaucgggaacgaggaguuccuggacuacaugcccagcaugaagcgguuccgcaaggaggaggaguccgagggcgccaucugguga

SEQ ID NO: 10072 - RNA, 9873 nt, Artificial Sequence
  derived and/or modified CDS sequence (opt1) from DENV-3__KF973482__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgugacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacgaucaucaucaccgugcacaccggggaccagcaccaggugggcaacgagacccagggggucacggccgagaucacgccccaggccagcaccaccgaggcgauccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggucaccuucaagaacgcccacgccaagaagcaggagguggugguccuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggagguguccgagacccagcacgggaccauccucaucaaggucgaguacaagggcgaggacgugccgugcaagauccccuucagcacggaggacgggcagggcaaggcgcacaacggccgccugaucaccgccaaccccguggucaccaagaaggaggagcccgugaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacacggccugggacuucggguccgucggcggggugcucaacagccugggcaagauggugcaccagaucuucggguccgcguacaccgcccuguucagcggcgucuccugggugaugaagaucggcaucggggugcuccugaccuggaucggccugaacagcaagaacaccuccaugagcuucuccugcaucgccaucgggaucaucacgcucuaccugggcgccgucgugcaggccgacauggggugcgugaucaacuggaagggcaaggagcugaagugcggcagcgggaucuucgucaccaacgaggugcacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccgucguggugggggacaucaucggcguccucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgugucccgggccuggaacgucugggagguggaggacuacggguucggcguguucaccaccaacaucuggcucaagcugcgcgaggucuacacccagcugugcgaccaccggcucaugagcgcggccgugaaggacgagcgcgccgugcacgccgacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccguggucaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccuggucuccgccggcagcgggaagguggacaacuucaccgugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucgggcucaaggacacgcugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugaccgucgagaaggccgcggacaucacgugggaggaggaggccgagcagaccggggugucccacaaccugaugaucaccguggacgacgacggcaccaugcgcaucaaggacgacgagaccgagaacauccucacgguccugcugaagaccgcccuccugaucgugagcggcaucuucccguacuccauccccgccacccugcucguguggcacaccuggcagaagcagacgcagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacaccauguggcacgugacgcgcggggcggugcucaccuacaacggcaagcgccuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggaccuuccagacgaccaccggcgagaucggggcgaucgcccuggacuucaagcccggcaccuccggcagccccaucaucaaccgcgaggggaagguggugggccuguacgggaacggcgucgugacgaagaacgggggcuacgugagcggcaucgcccagaccaacgccgagccggacgggcccacccccgagcuggaggaggagauguucaagaagcggaaccucaccaucauggaccugcaccccggcuccgggaagacgcgcaaguaccugccggccaucguccgggaggcgaucaagcgccggcuccgcacccugauccuggcccccacccgggugguggccgccgagauggaggaggcccucaagggccugcccauccgcuaccagaccacggcgaccaagagcgagcacaccgggcgggagaucgucgaccugaugugccacgccaccuucacgaugcgccuccugucccccgugcgggugccgaacuacaaccugaucaucauggacgaggcccacuucaccgaccccgccagcaucgccgcgcgcggcuacaucuccacccgggucggcaugggggaggccgccgccaucuucaugaccgcgacgccgcccggcaccgccgacgccuucccgcagagcaacgcccccauccaggacgaggagcgcgacauccccgagcgcuccuggaacagcgggaacgaguggaucaccgacuucgccggcaagaccgugugguucgugcccuccaucaaggcggggaacgacaucgccaacugccuccggaagaacggcaagaaggucauccagcugagccgcaagacguucgacaccgaguaccagaagaccaagcugaacgacugggacuucguggugaccacggacaucuccgagaugggcgccaacuucaaggccgaccgggucaucgacccgcgccggugccucaagcccgugauccugaccgacgggcccgagcgcgugauccuggccggccccaugccggucaccgcggccagcgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacgcccgagggcaucaucccggcccucuucgagcccgagcgggagaaguccgccgccaucgacggcgaguaccgccugaagggggagagccggaagaccuucguggagcugaugcgccggggcgaccuccccgucuggcuggcgcacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcacguacagcgacccgcuggcccucaaggaguucaaggaguucgccgcggggcgcaaguccaucgcccuggaccuggugaccgagaucggccgggugcccagccaccucgcccaccgcacccggaacgcccuggacaaccuggucaugcuccacaccuccgagcacgggggccgcgccuaccggcacgcgguggaggagcugcccgagacgauggagacccugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgccuccgcgaucguccuggaguucuucaugauggugcuccugauccccgagcccgagaagcagcgcacgccccaggacaaccagcuggccuacguggucaucggcauccucacccuggccgccaucaucgccgcgaacgagaugggccugcucgagaccaccaagcgggaccuggggaugagcaaggagccgggcguggugucccccacgagcuaccuggacgucgaccuccaccccgccuccgccuggacccuguacgccguggcgaccaccgugaucacgcccaugcugcgccacaccaucgagaacagcaccgccaacgucucccucgccgccaucgccaaccaggcgguggugcugauggggcuggacaagggcuggccgaucagcaagauggaccucggggucccccugcuggcccucggcugcuacucccaggugaacccccugacccugacggccgccgugcuccugcugaucacccacuacgccaucaucggccccgggcuccaggcgaaggccacccgggaggcccagaagcgcaccgccgccggcaucaugaagaacccgacggucgacgggaucaugaccaucgaccuggaccccgugaucuacgacagcaaguucgagaagcagcugggccaggugaugcuccugguccugugcgcggugcagcuccugcugaugcggaccuccugggcccucugcgaggcccugacccuggccacgggccccaucaccacccucugggaggggagccccggcaaguucuggaacaccacgaucgcgguguccauggccaacaucuuccgcgggagcuaccuggccggcgccgggcuggccuucuccaucaugaaguccgucggcaccggcaagcgggggaccggcucccagggggagacccucggcgagaaguggaagaagaagcugaaccagcugagccgcaaggacuucgaccucuacaagaaguccgggaucaccgagguggaccggacggaggcgaaggagggccugaagcgcggcgagaucacccaccacgccgugucccgggggagcgccaagcugcagugguucgucgagcgcaacauggugaucccggagggccgggugaucgaccucgggugcggccgcgggggcugguccuacuacugcgccggccugaagaaggucaccgaggugcggggguacaccaagggcgggcccggccacgaggagcccgugcccaugagcacguacggguggaacaucgucaagcugauguccggcaaggacguguucuaccucccgcccgagaagugcgacacccugcugugcgacaucggcgagagcucccccagccccaccguggaggagucccgcaccauccgcguccugaagaugguggagccguggcucaagaacaaccaguucugcaucaaggugcugaaccccuacaugcccacggucaucgagcaccuggagcggcuccagcgcaagcacgggggcaugcuggugcggaacccccugagccgcaacuccacccacgagauguacuggaucagcaacgggaccggcaacaucguggccuccgucaacauggugagccggcuccugcugaaccgcuucaccaugacgcaccggcgcccgaccaucgagaaggacguggaccucggcgcggggacccggcacgucaacgccgagcccgagacccccaacauggacgugaucggcgagcgcaucaagcggaucaaggaggagcacaacuccacguggcacuacgacgacgagaacccguacaagaccugggccuaccacgggagcuacgaggugaaggccaccggcuccgccagcuccaugaccaacggggucgugaagcugcugacgaagcccugggacgucgugcccauggugacccagauggcgaugaccgacaccacgcccuucggccagcagcgcgucuucaaggagaagguggacacccggaccccgcgcagcaugcccggcacccggcgcgugauggggaucacggccgaguggcucuggcggacccugggccgcaacaagaagccccggcugugcacccgcgaggaguucaccaagaagguccgcacgaacgccgccaugggggcgguguucaccgaggagaaccagugggacagcgccaaggccgccguggaggacgaggacuucuggaagcucgucgaccgggagcgcgagcugcacaagcugggcaagugcggguccugcguguacaacaugaugggcaagcgggagaagaagcucggcgaguucgggaaggccaagggcagccgcgcgaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgccgacgacaccgcgggcugggacacccgcaucacggaggacgaccugcacaacgaggagaagaucacccagcagauggacccggagcaccggcagcucgccaacgccaucuucaagcugaccuaccagaacaaggucgugaaggugcagcgccccacccccaccggcacggucauggacaucaucucccggaaggaccagcgcgggagcggccagguggggaccuacggccugaacaccuucaccaacauggaggcccagcucauccggcagauggagggggagggcgugcuguccaaggccgaccuggagaacccccaccucccggagaagaagaucacgcaguggcuggagaccaagggcgucgagcgccugaagcggauggcgaucagcggggacgacugcguggugaagcccaucgacgaccgcuucgccaacgcccuccuggcccugaacgacaugggcaagguccggaaggacaucccccaguggcagcccuccaagggguggcacgacuggcagcaggucccguucugcagccaccacuuccacgagcucaucaugaaggacggccgcaagcuggugguccccugccggccccaggacgagcugaucgggcgcgcccggaucucccagggcgcgggcuggagccucaaggagaccgccugccuggggaaggccuacgcccagauguggucccugauguacuuccaccgccgcgaccuccggcuggcgagcaacgccaucugcuccgccgugcccgugcacugggucccgaccagccgcacgaccugguccauccacgcccaccaccaguggaugaccaccgaggacaugcugacgguguggaaccggguguggaucgaggacaaccccuggauggaggacaagacccccgucaccaccugggagaacgugcccuaccucggcaagcgcgaggaccaguggugcgggagccugaucggccugacgagccgggccaccugggcgcagaacaucccgaccgccauccagcagguccgcucccucaucgggaacgaggaguuccuggacuacaugcccagcaugaagcgguuccgcaaggaggaggaguccgagggcgccaucugguga

SEQ ID NO: 10073 - RNA, 9873 nt, Artificial Sequence
  derived and/or modified CDS sequence (opt1) from DENV-3__KF973483__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgcgccgugcaagauccccuucagcacggaggacgggcagggcaaggcccacaacggccgccugaucaccgccaaccccguggucaccaagaaggaggagcccgugaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacacggcgugggacuucggguccgucggcggggugcucaacagccugggcaagauggugcaccagaucuucggguccgccuacaccgcccuguucagcggcgucuccugggugaugaagaucggcaucggggugcuccugaccuggaucggccugaacagccgcaacaccuccaugagcuucuccugcaucgccaucgggaucaucacgcucuaccugggcgccgucgugcaggcggacauggggugcgugaucaacuggaagggcaaggagcugaagugcggcagcgggaucuucgucaccaacgaggugcacaccuggaccgagcaguacaaguuccaggccgacucccccaagcgccucgccacggccaucgugggcgccugggagaacggggucugcggcauccggagcaccacccgcauggagaaccugcuguggaagcagaucgcgaacgagcucaacuacauccugugggagaacaacaucaagcugaccgugguggucggggacaucaucggcgugcucgagcagggcaagcggacgcugacgccccagccgauggagcugaaguacuccuggaagaccugggggaaggccaagaucgugaccgccgagacgcagaacagcuccuucaucaucgacggccccaacacccccgagugccccagcgucucccgcgccuggaacgugugggagguggaggacuacggguucggcgucuucaccaccaacaucuggcucaagcugcgggagaccuacacgcagcugugcgaccaccgccucaugagcgcggccgugaaggacgagcgggccgugcacgccgacaugggcuacuggaucgagagccagaagaacggguccuggaagcuggagaaggccagccugaucgaggucaagaccugcaccuggccgaagucccacaccaucuggagcaacggcgugcucgaguccgacaugaucauccccaagagccuggcggggcccaucucccagcacaaccaccgcccgggcuaccacacgcagaccgccgggcccuggcaccugggcaagcucgagcuggacuucaacuacugcgagggcaccaccguggucaucacggagaacugcgggacccggggccccagccugcgcaccaccacgguguccgggaagcucauccacgaguggugcugccggagcugcacccugcccccgcugcgcuacaugggcgaggacgggugcugguacggcauggagauccggcccaucuccgagaaggaggagaacauggucaagagccucgucuccgccggcagcgggaagguggacaacuucaccaugggcgugcugugccuggccauccucuucgaggaggucaugcgcgggaaguucggcaagaagcacaugaucgccgggguguuccugaccuucgugcugcuccuguccggccagaucacguggcgggacauggcgcacacccugaucaugaucggcagcaacgccuccgaccgcauggggaugggcgucaccuaccucgcccugaucgccaccuucaagauccagcccuuccuggcccucggguucuuccugcggaagcugacgagccgcgagaaccuccugcugggcgugggccucgcgauggccaccacccugcagcugcccgaggacaucgagcagauggccaacgggaucgcccucggccugauggcgcugaagcucaucacccaguucgagacguaccagcuguggaccgcccugaucagccugaccugcuccaacaccaucuucacgcugaccguggccuggcggaccgccacccugauccucgccggggucagccugcugccggugugccaguccagcuccaugcgcaagacggacuggcuccccauggcggucgccgccaugggcgugccgccccucccgcuguucaucuucagccucaaggacacccugaagcgccgguccuggccccugaacgagggggugauggccgucggccucgugagcauccuggccuccagccugcuccgcaacgacgugcccauggcgggcccccuggucgccgggggccugcucaucgccugcuacgugaucaccgggaccuccgccgaccugacgguggagaaggccgcggacaucaccugggaggaggaggccgagcagaccggcgucagccacaaccugaugaucaccguggacgacgacgggaccaugcggaucaaggacgacgagacggagaacauccucaccgugcugcugaagaccgcccuccugaucgucuccggcaucuucccguacagcauccccgccacccugcucguguggcacacguggcagaagcagacccagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacacgauguggcacgucacccgcggcgcggugcucaccuacaacgggaagcggcuggagcccaacugggccuccgugaagaaggaccugaucagcuacggcgggggcuggcgccucuccgcccaguggcagaagggggaggagguccaggugaucgccguggagcccggcaagaaccccaagaacuuccagaccaugcccggcacguuccagaccaccaccggggagaucggcgcgaucgcccuggacuucaagcccgggacgagcggcagccccaucaucaaccgggagggcaaggucguggggcuguacggcaacgggguggucaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggccaucgugcgcgaggcgaucaagcggcgccuccggacccugauccuggcccccacccgcgucguggccgccgagauggaggaggcccucaaggggcugcccauccgguaccagacgaccgcgaccaaguccgagcacaccggccgcgagaucguggaccugaugugccacgccacguucaccaugcggcuccugagccccguccgcgugccgaacuacaaccugaucaucauggacgaggcccacuucaccgaccccgccuccaucgccgcgcggggguacaucagcacccgcgugggcaugggcgaggccgccgccaucuucaugacggcgacgccgcccgggaccgccgacgccuucccgcaguccaacgcccccauccaggacgaggagcgcgacauccccgagcggagcuggaacuccggcaacgaguggaucaccgacuucgccgggaagacggucugguucgugcccagcaucaaggcgggcaacgacaucgccaacugccuccgcaagaacgggaagaaggugauccagcugucccggaagaccuucgacaccgaguaccagaagaccaagcugaacgacugggacuucgucgugacgaccgacaucagcgagaugggcgccaacuucaaggccgaccgcgugaucgacccgcggcgcugccucaagcccgucauccugaccgacggccccgagcgggugauccuggccgggcccaugccggugaccgcggccuccgccgcccagcgccggggccgcgucgggcggaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgcgagaaguccgccgccaucgacggcgaguaccggcugaagggcgagucccgcaagaccuucguggagcugaugcggcgcggggaccuccccguguggcuggcgcacaaggucgccagcgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacuccgacccgcuggcccucaaggaguucaaggaguucgccgcgggccgcaagagcaucgcccuggaccuggucaccgagaucgggcgcgugcccucccaccucgcccaccggacccgcaacgcccuggacaaccuggugaugcuccacacgagcgagcacggcgggcgggccuaccgccacgcggucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccacgaagcgcgaccugggcauguccaaggagccgggggucgugagccccaccuccuaccuggacguggaccuccaccccgccagcgccuggacccuguacgccgucgcgaccacggugaucacccccaugcugcggcacaccaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacgcugaccgccgccgugcuccugcugaucacccacuacgccaucaucggccccggccuccaggcgaaggccacccgcgaggcccagaagcggacggccgccgggaucaugaagaacccgaccguggacggcaucaugaccaucgaccuggaccccgucaucuacgacuccaaguucgagaagcagcugggccaggugaugcuccuggugcugugcgcgguccagcuccugcugaugcgcaccagcugggcccucugcgaggcccugacgcuggccaccggccccaucaccacccucugggagggcucccccgggaaguucuggaacacgaccaucgcggugagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggacuucgaccucuacaagaaguccggcaucacggaggucgaccgcaccgaggcgaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccgcacgauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugucccggaacagcacccacgagauguacuggaucuccaacggcaccgggaacaucguggccagcgugaacauggucucccgccuccugcugaaccgguucacgaugacccaccgccggccgaccaucgagaaggacguggaccucggcgcgggcacccgccacgugaacgccgagcccgagacgcccaacauggacgucaucggggagcggaucaagcgcaucaaggaggagcacaacagcaccuggcacuacgacgacgagaacccguacaagaccugggccuaccacggcuccuacgaggugaaggccaccgggagcgccuccagcaugaucaacggcguggucaagcugcugacgaagcccugggacgugguccccauggugacccagauggcgaugaccgacaccacgcccuucgggcagcagcggguguucaaggagaaggucgacacccgcaccccgcggagcaugcccggcacccgccgggugaugggcaucacggccgaguggcucuggcgcacccuggggcggaacaagaagccccgccugugcacccgcgaggaguucaccaagaaggugcggacgaacgccgccaugggcgcggucuucaccgaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggucaaggugcagcggcccacccccaccggcacggugauggacaucaucagccgcaaggaccagcggggcuccgggcaggucggcaccuacgggcugaacaccuucaccaacauggaggcccagcucauccgccagauggagggcgagggggugcugagcaaggccgaccuggagaacccccaccucccggagaagaagaucacgcaguggcuggagaccaagggcguggagcggcugaagcgcauggcgaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggcgggcuggucccucaaggagaccgccugccugggcaaggccuacgcccagauguggagccugauguacuuccaccgccgggaccuccgccuggcguccaacgccaucugcagcgccguccccgugcacugggugccgaccucccggacgaccuggagcauccacgcccaccaccaguggaugaccaccgaggacaugcugacggucuggaaccgcguguggaucgaggacaaccccuggauggaggacaagacccccgugaccaccugggagaacguccccuaccucgggaagcgggaggaccaguggugcggcagccugaucgggcugacgucccgcgccaccugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 10074 - RNA, 9873 nt, Artificial Sequence
  derived and/or modified CDS sequence (opt1) from DENV-3__KF973485__SS-prME
accagccucugccucaugaugauccugcccgcggcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaacaagaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccgccugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccggcugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccgcggcgcccggcgcauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcggcucgccacggccaucgccggcgccugggagaacggggucugcggcauccgcagcaccacccgcauggagaaccugcuguggaagcagaucgcgaacgagcucaacuacauccugugggagaacaacaucaagcugaccgugguggucggggacaucaucggcgugcucgagcagggcaagcggacgcugacgccccagccgauggagcugaaguacuccuggaagaccugggggaaggccaagaucgugaccgccgagacgcagaacagcuccuucaucaucgacggccccaacacccccgagugccccagcgucucccgcgccuggaacgugugggagguggaggacuacggguucggcgucuucaccaccaacaucuggcucaagcugcgggaggugcacacccagcugugcgaccaccgccucaugagcgcggccgugaaggacgagcgggccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccgcccgggcuaccacacccagacggccgggcccuggcaccucggcaagcuggagcuggacuucaacuacugcgagggcaccaccgucgugaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccugguguccgccggcagcgggaagguggacaacuucaccaugggcguccugugccucgccauccuguucgaggaggugaugcgcgggaaguucggcaagaagcacaugaucgccgggguguucuucaccuucguccugcuccuguccggccagaucaccuggcgggacauggcgcacacgcugaucaugaucggcagcaacgccuccgaccgcauggggaugggcgugaccuaccucgcccugaucgccaccuucaagauccagcccuuccuggcccucggguucuuccugcggaagcugaccagccgcgagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcggaccgccacccugauccucgccggggugagccugcugccggucugccaguccagcuccaugcgcaagaccgacuggcuccccauggcgguggccgccaugggcgugccgccccucccgcuguucaucuucgggcucaaggacacgcugaagcggcgcagcuggccccugaacgagggcgucauggccgugggccucguguccauccuggccagcucccugcuccgcaacgacguccccauggcggggccccugguggccggcgggcugcucaucgccugcuacgugaucaccggcaccagcgccgaccugaccgucgagaaggccgcggacaucacgugggaggaggaggccgagcagaccggggugucccacaaccugaugaucaccguggacgacgacggcaccaugcggaucaaggacgacgagaccgagaacauccucacgguccugcugaagaccgcccuccugaucgugagcggcaucuucccguacuccauccccgccacccugcucguguggcacaccuggcagaagcagacgcagcgcagcgggguccugugggacgugcccagcccgcccgagacccagaaggccgagcuggaggagggcguguaccggaucaagcagcaggggaucuucggcaagacccaggucggggugggcgugcagaaggagggcgucuuccacaccauguggcacgugacgcgcggggcggugcucaccuacaacggcaagcggcuggagcccaacugggccagcgucaagaaggaccugaucuccuacgggggcggguggcgccucagcgcccaguggaagaagggcgaggagguccaggugaucgccgucgagcccggcaagaaccccaagaacuuccagaccaugcccgggaccuuccagacgaccaccggcgagaucggggcgaucgcccuggacuucaagcccggcaccuccggcagccccaucaucaaccgggaggggaagguggugggccuguacgggaacggcgucgugacgaagaacgggggcuacgugagcggcaucgcccagaccaacgccgagccggacgggcccacccccgagcuggaggaggagauguucaagaagcgcaaccucaccaucauggaccugcaccccggcuccgggaagacgcggaaguaccugccggccaucguccgcgaggcgaucaagcggcgccuccggacccugauccuggcccccacccgcgugguggccgccgagauggaggaggcccucaagggccugcccauccgguaccagaccacggcgaccaagagcgagcacaccgggcgcgagaucgucgaccugaugugccacgccaccuucacgaugcggcuccugucccccgugcgcgugccgaacuacaaccugaucaucauggacgaggcccacuucaccgaccccgccagcaucgccgcgcggggcuacaucuccacccgcgucggcaugggggaggccgccgccaucuucaugaccgcgacgccgcccggcaccgccgacgccuucccgcagagcaacgcccccauccaggacgaggagcgggacauccccgagcgcuccuggaacagcgggaacgaguggaucaccgacuucgccggcaagaccgugugguucgugcccuccaucaaggcggggaacgacaucgccaacugccuccgcaagaacggcaagaaggucauccagcugagccggaagacguucgacaccgaguaccagaagaccaagcugaacgacugggacuucguggugaccacggacaucuccgagaugggcgccaacuucaaggccgaccgcgucaucgacccgcggcgcugccucaagcccgugauccugaccgacgggcccgagcgggugauccuggccggccccaugccggucaccguggcgagcgccgcccagcgccgggggcgcgugggccggaacccccagaaggagaacgaccaguacaucuucaccgggcagccccucaacaacgacgaggaccacgcccacuggaccgaggccaagaugcugcuggacaacaucaacacgcccgagggcaucaucccggcccucuucgagcccgagcgcgagaaguccgccgccaucgacggcgaguaccggcugaagggggagagccgcaagaccuucgucgagcugaugcggcgcggcgaccuccccguguggcuggcccacaaggucgcguccgaggggaucaaguacaccgaccggaaguggugcuucgacggccagcgcaacaaccagauccuggaggagaacauggacguggagaucuggaccaaggagggcgagaagaagaagcuccggccccgcuggcuggacgcccggacguacagcgacccgcuggcccucaaggaguucaaggaguucgccgccgggcgcaaguccaucgcgcuggaccuggugaccgagaucggccgcguccccagccaccucgcccaccggacccgcaacgcccuggacaaccuggugaugcuccacaccuccgagcacgggggccgggccuaccgccacgccguggaggagcugcccgagacgauggagacccugcuccugcuggggcucaugauccugcugaccggcggcgcgaugcuguuccugaucagcgggaagggcaucgggaagaccagcaucggccugaucugcgucaucgccuccagcgggaugcucuggauggccgagaucccgcugcaguggaucgccuccgccaucgugcuggaguucuucaugauggugcuccugauccccgagcccgagaagcagcggacgccccaggacaaccagcuggcguacgucgugaucggcauccucacccuggccgccaucaucgccgccaacgagaugggccugcucgagaccaccaagcgcgaccuggggaugagcaaggagccgggcguggucucccccacgagcuaccuggacguggaccuccaccccgcguccgccuggacccuguacgccguggccaccaccgucaucacgcccaugcugcggcacaccaucgagaacagcaccgcgaacgugucccucgccgccaucgccaaccaggccgugguccugauggggcuggacaagggcuggccgaucagcaagauggaccucggggugccccugcuggcgcucggcugcuacucccaggugaacccccugacccugacggccgccguccuccugcugaucacccacuacgccaucaucggccccgggcuccaggccaaggcgacccgcgaggcccagaagcggaccgccgccggcaucaugaagaacccgacgguggacgggaucaugaccaucgaccuggaccccgugaucuacgacagcaaguucgagaagcagcugggccaggucaugcuccuggugcugugcgugguccagcuccugcugaugcgcaccuccugggcccucugcgaggcgcugacccuggccacgggccccaucaccacccucugggaggggagccccggcaaguucuggaacaccacgaucgccguguccauggccaacaucuuccgggggagcuaccuggcgggcgccgggcuggccuucuccaucaugaaguccgugggcaccggcaagcgcgggaccggcucccagggggagacccucggcgagaaguggaagaagaagcugaaccagcugagccggaaggacuucgaccucuacaagaaguccgggaucaccgaggucgaccgcacggaggccaaggagggccugaagcggggcgagaucacccaccacgccgugucccgcgggagcgcgaagcugcagugguucguggagcggaacauggucaucccggagggccgcgugaucgaccucgggugcggccgcgggggcugguccuacuacugcgccggccugaagaaggugaccgagguccgcggguacaccaagggcgggcccggccacgaggagcccgugcccaugagcacguacggguggaacaucgugaagcugauguccggcaaggacgucuucuaccucccgcccgagaagugcgacacccugcugugcgacaucggcgagagcucccccagccccaccguggaggagucccggaccauccgcgugcugaagauggucgagccguggcucaagaacaaccaguucugcaucaaggugcugaaccccuacaugcccacggugaucgagcaccuggagcgccuccagcggaagcacgggggcaugcugguccgcaacccccugagccggaacuccacccacgagauguacuggaucagcaacgggaccggcaacaucguggccuccgugaacauggucagccgccuccugcugaaccgguucaccaugacgcaccgccggccgaccaucgagaaggacguggaccucggcgccgggacccgccacgugaacgccgagcccgagacccccaacauggaggucaucggcgagcggaucaagcgcaucaaggaggagcacaacuccacguggcacuacgacgacgagaacccguacaagaccugggcguaccacgggagcuacgaggugaaggccaccggcuccgccagcuccaugaucaacggggucgugaagcugcugaccaagcccugggacauggugcccauggucacgcagauggccaugaccgacaccacccccuucggccagcagcggguguucaaggagaagguggacacgcgcaccccgcggagcaugcccggcacccgccgggucauggggaucaccgccgaguggcucuggcgcacgcugggccggaacaagaagccccgccugugcacccgggaggaguucaccaagaaggugcgcaccaacgcggccaugggggccguguucacggaggagaaccagugggacagcgccaaggcggccgucgaggacgaggacuucuggaagcucguggaccgcgagcgggagcugcacaagcugggcaagugcggguccugcguguacaacaugaugggcaagcgcgagaagaagcucggcgaguucgggaaggccaagggcagccgggccaucugguacauguggcugggggcccgcuaccuggaguucgaggcgcucggcuuccugaacgaggaccacugguucucccgggagaacagcuacuccggggucgagggcgagggccugcacaagcucggguacauccugcgcgacaucagcaagauccccggcggggccauguacgccgacgacaccgccggcugggacacccggaucaccgaggacgaccugcacaacgaggagaagaucacgcagcagauggacccggagcaccgccagcucgccgacgcgaucuucaagcugaccuaccagaacaagguggugaagguccagcggcccacccccaccggcaccgugauggacaucaucucccgcaaggaccagcgggggagcggccagguggggacguacggccugaacaccuucaccaacauggaggcccagcucauccgccagauggagggggagggcguccuguccaaggccgaccuggagaacccccaccucccggagaagaagaucacccaguggcuggagacgaagggcguggagcggcugaagcgcauggccaucagcggggacgacugcguggucaagcccaucgacgaccgguucgccaacgcgcuccuggcccugaacgacaugggcaaggugcgcaaggacaucccccaguggcagcccuccaagggguggcacgacuggcagcaggucccguucugcagccaccacuuccacgagcucaucaugaaggacggccggaagcuggucgugcccugccgcccccaggacgagcugaucgggcgggcccgcaucucccagggcgccggcuggagccucaaggagaccgccugccuggggaaggcguacgcccagauguggucccugauguacuuccaccggcgcgaccuccgccuggccagcaacgccaucugcuccgcggugcccguccacugggugccgaccagccggaccacgugguccauccacgcccaccaccaguggaugaccaccgaggacaugcugaccguguggaaccgcgucuggaucgaggacaaccccuggauggaggacaagacgcccgugaccaccugggagaacgugcccuaccucggcaagcgggaggaccaguggugcgggagccugaucggccugaccagccgcgccacgugggcccagaacaucccgaccgccauccagcagguccggucccucaucgggaacgaggaguuccuggacuacaugcccagcaugaagcgcuuccggaaggaggaggaguccgagggcgcgaucugguga

SEQ ID NO: 10075 - RNA, 9873 nt, Artificial Sequence
  derived and/or modified CDS sequence (opt1) from DENV-3__KF973486__SS-prME
accagccugugccucaugaugauccugcccgccgcccuggcguuccaccucaccagccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgccgggguguucuucaccuucguccugcuccuguccggccagaucaccuggcgcgacauggcgcacacgcugaucaugaucggcagcaacgccuccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucgggcucaaggacacgcugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugaccgucgagaaggccgcggacaucacgugggaggaggaggccgagcagaccggggugucccacaaccugaugaucaccguggacgacgacggcaccaugcgcaucaaggacgacgagaccgagaacauccucacgguccugcugaagaccgcccuccugaucgugagcggcaucuucccguacuccauccccgccacccugcucguguggcacaccuggcagaagcagacgcagcggagcgggguccugugggacgugcccagcccgcccgagacccagaaggccgagcuggaggagggcguguaccgcaucaagcagcaggggaucuucggcaagacccaggucggggugggcgugcagaaggagggcgucuuccacaccauguggcacgugacgcgcggggccgugcucaccuacaacggcaagcggcuggagcccaacugggccagcgucaagaaggaccugaucuccuacgggggcggguggcggcucagcgcccaguggcagaagggcgaggagguccaggugaucgccgucgagcccggcaagaaccccaagaacuuccagaccaugcccgggaccuuccagacgaccaccggcgagaucggggcgaucgcccuggacuucaagcccggcaccuccggcagccccaucaucaaccgcgaggggaagguggugggccuguacgggaacggcgucgugacgaagaacgggggcuacgugagcggcaucgcccagaccaacgccgagccggacgggcccacccccgagcuggaggaggagauguucaagaagcggaaccucaccaucauggaccugcaccccggcuccgggaagacgcgcaaguaccugccggccaucguccgggaggcgaucaagcgccggcuccgcacccugauccuggcccccacccgggugguggccgccgagauggaggaggcccucaagggccugcccauccgcuaccagaccacggcgaccaagagcgagcacaccgggcgggagaucgucgaccugaugugccacgccaccuucacgaugcgccuccugucccccgugcgggugccgaacuacaaccugaucaucauggacgaggcccacuucaccgaccccgccagcaucgccgcgcgcggcuacaucuccacccgggucggcaugggggaggccgccgccaucuucaugaccgcgacgccgcccggcaccgccgacgccuucccgcagagcaacgcccccauccaggacgaggagcgcgacauccccgagcgcuccuggaacagcgggaacgaguggaucaccgacuucgccggcaagaccgugugguucgugcccuccaucaaggcggggaacgacaucgccaacugccuccggaagaacggcaagaaggucauccagcugagccgcaagacguucgacaccgaguaccagaagaccaagcugaacgacugggacuucguggugaccacggacaucuccgagaugggcgccaacuucaaggccgaccgggucaucgacccgcgccggugccucaagcccgugauccugaccgacgggcccgagcgcgugauccuggccggccccaugccggucaccgcggccagcgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacgcccgagggcaucaucccggcccucuucgagcccgagcgggagaaguccgccgccaucgacggcgaguaccgccugaagggggagagccggaagaccuucguggagcugaugcgccggggcgaccuccccgucuggcuggcgcacaagguggccuccgaggggaucaaguacaccgaccgcaaguggugcuucgacggccagcggaacaaccagauccuggaggagaacauggacgucgagaucuggaccaaggagggcgagaagaagaagcuccgcccccgguggcuggacgcccgcacguacagcgacccgcuggcccucaaggaguucaaggaguucgccgcggggcgcaaguccaucgcccuggaccuggugaccgagaucggccgggugcccagccaccucgcccaccgcacccggaacgcccuggacaaccuggucaugcuccacaccuccgagcacgggggccgcgccuaccggcacgcgguggaggagcugcccgagacgauggagacccugcuccugcuggggcucaugauccugcugaccggcggcgccaugcuguuccugaucagcgggaagggcaucgggaagaccagcaucggccugaucugcgugaucgccuccagcgggaugcucuggauggccgagaucccgcugcaguggaucgccuccgcgaucguccuggaguucuucaugauggugcuccugauccccgagcccgagaagcagcgcacgccccaggacaaccagcuggccuacguggucaucggcauccucacccuggccgccaucaucgccgcgaacgagaugggccugcucgagaccaccaagcgggaccuggggaugagcaaggagccgggcguggugucccccacgagcuaccuggacgucgaccuccaccccgccuccgccuggacccuguacgccguggcgaccaccgugaucacgcccaugcugcgccacaccaucgagaacagcaccgccaacgucucccucgccgccaucgccaaccaggcgguggugcugauggggcuggacaagggcuggccgaucagcaagauggaccucggggcgccccuccuggcccucggcugcuacucccaggucaacccccugacccugacggccgccgugcuccugcugaucacccacuacgcgaucaucggccccgggcuccaggccaaggccacccgggaggcccagaagcgcaccgccgcgggcaucaugaagaacccgacgguggacgggaucaugaccaucgaccuggaccccgucaucuacgacagcaaguucgagaagcagcugggccaggugaugcuccuggugcugugcgccguccagcuccugcugaugcggaccuccugggcccucugcgaggcccugacccuggcgacgggccccaucaccacccucugggaggggagccccggcaaguucuggaacaccacgaucgccguguccauggccaacaucuuccgcgggagcuaccuggccggcgccgggcuggcguucuccaucaugaaguccgugggcaccggcaagcgggggaccggcucccagggggagacccucggcgagaaguggaagaagaagcugaaccagcugagccgcaaggacuucgaccucuacaagaaguccgggaucaccgaggucgaccggacggaggccaaggagggccugaagcgcggcgagaucacccaccacgccgugucccgggggagcgccaagcugcagugguucguggagcgcaacauggucaucccggagggccgggugaucgaccucgggugcggccgcgggggcugguccuacuacugcgccggccugaagaaggugaccgagguccggggguacaccaagggcgggcccggccacgaggagcccgugcccaugagcacguacggguggaacaucgugaagcugauguccggcaaggacgucuucuaccucccgcccgagaagugcgacacccugcugugcgacaucggcgagagcucccccagccccaccguggaggagucccgcaccauccgcgugcugaagauggucgagccguggcucaagaacaaccaguucugcaucaaggugcugaaccccuacaugcccacggugaucgagcaccuggagcggcuccagcgcaagcacgggggcaugcugguccggaacccccugagccgcaacuccacccacgagauguacuggaucagcaacgggaccggcaacaucguggcguccgugaacauggucagccggcuccugcugaaccgcuucaccaugacgcaccggcgcccgaccaucgagaaggacguggaccucggcgccgggacccggcacgugaacgccgagcccgagacccccaacauggacgucaucggcgagcgcaucaagcggaucaaggaggagcacaacuccacguggcacuacgacgacgagaacccguacaagaccugggccuaccacgggagcuacgaggugaaggccaccggcuccgcgagcuccaugaucaacgggguggucaagcugcugaccaagcccugggacgugguccccauggugacgcagauggccaugaccgacaccacccccuucggccagcagcgcguguucaaggagaaggucgacacgcggaccccgcgcagcaugcccggcacccggcgcgugauggggaucaccgccgaguggcucuggcggacgcugggccgcaacaagaagccccggcugugcacccgcgaggaguucaccaagaaggugcgcaccaacgccgcgaugggggccgucuucacggaggagaaccagugggacagcgccaaggccgccguggaggacgaggacuucuggaagcucguggaccgggagcgcgagcugcacaagcugggcaagugcggguccugcgucuacaacaugaugggcaagcgggagaagaagcucggcgaguucgggaaggcgaagggcagccgcgccaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgcggacgacaccgccggcugggacacccgcaucaccgaggacgaccugcacaacgaggagaagaucacgcagcagauggacccggagcaccggcagcucgccaacgccaucuucaagcugaccuaccagaacaagguggucaaggugcagcgccccacccccaccggcaccgugauggacaucaucucccggaaggaccagcgcgggagcggccaggucgggacguacggccugaacaccuucaccaacauggaggcccagcucauccggcagauggagggggagggcgugcuguccaaggcggaccuggagaacccccaccucccggagaagaagaucacccaguggcuggagacgaagggcguggagcgccugaagcggauggccaucagcggggacgacugcgucgugaagcccaucgacgaccgcuucgccaacgcccuccuggcccugaacgacaugggcaaggugcggaaggacaucccccaguggcagcccuccaagggguggcacgacuggcagcaggucccguucugcagccaccacuuccacgagcucaucaugaaggacggccgcaagcugguggugcccugccggccccaggacgagcugaucgggcgcgcgcggaucucccagggcgccggcuggagccucaaggagaccgccugccuggggaaggccuacgcgcagauguggucccugauguacuuccaccgccgcgaccuccggcuggccagcaacgccaucugcuccgccguccccgugcacugggugccgaccagccgcaccacgugguccauccacgcccaccaccaguggaugaccaccgaggacaugcugaccgucuggaaccggguguggaucgaggacaaccccuggauggaggacaagacgcccgugaccaccugggagaacguccccuaccucggcaagcgcgaggaccaguggugcgggagccugaucggccugaccagccgggcgacgugggcccagaacaucccgaccgccauccagcagguccgcucccucaucgggaacgaggaguuccuggacuacaugcccagcaugaagcgguuccgcaaggaggaggaguccgagggcgccaucugguga

SEQ ID NO: 10076 - RNA, 9873 nt, Artificial Sequence
  derived and/or modified CDS sequence (opt1) from DENV-3__FJ898458__SS-prME
accagccucugccucaugaugauccugcccgccgcccuggcguuccaccucaccagccgggacggggagccgcggaugaucguggggaagaacgagcgggggaagacccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcggagcguggcccucgcgccccacgugggcauggggcuggacacccgcacccagaccuggauguccgccgagggcgccuggcgccagguggagaagguggagaccugggcccugcgccacccgggguucaccauccucgcgcuguuccuggcccacuacaucggcaccagccucacgcagaagguggugaucuucauccugcugaugcucgucacccccuccaugaccaugcggugcgugggggugggcaaccgcgacuucgucgagggccugagcggggccaccuggguggacgugguccuggagcacggcgggugcgugacgaccauggccaagaacaagcccacccucgacaucgagcugcagaagaccgaggccacgcagcuggcgacccuccggaagcugugcaucgagggcaagaucaccaacaucaccacggacucccgcugccccacccagggcgaggccgugcugccggaggagcaggaccagaacuacgucugcaagcacaccuacguggaccggggguggggcaacgggugcggccucuucgggaagggcagccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccuccaccaccgaggcgauccugcccgaguacggcacccuggggcucgagugcagcccgcgcacgggccuggacuucaacgagaugauccugcucaccaugaagaacaaggccuggauggugcaccggcagugguucuucgaccugccccugcccuggaccuccggcgccaccacggagacccccaccuggaaccgcaaggagcuccuggugaccuucaagaacgcccacgccaagaagcaggaggucguggugcuggggagccaggagggcgcgaugcacacggcccucaccggggccaccgagauccagaacuccggcgggaccagcaucuucgccggccaccugaagugccggcugaagauggacaagcucgagcugaagggcauguccuacgccaugugcacgaacaccuucguccugaagaaggaggugagcgagacccagcacgggaccauccucaucaagguggaguacaagggcgaggacgucccgugcaagauccccuucuccacggaggacgggcacggcaaggcgcacaacggccgccugaucaccgccaaccccguggugaccaagaaggaggagcccgucaacaucgaggccgagccgcccuucggggagagcaacaucgugaucggcaucggggacaacgcccugaagaucaacugguacaagaagggcagcuccaucgggaagauguucgaggcgaccgcccggggcgcccgccggauggccauccugggcgacacggccugggacuucgggagcgugggcgggguccucaacucccugggcaagauggugcaccagaucuucgggagcgcguacaccgcccuguucuccggcgugagcugggucaugaagaucggcaucggggugcuccugaccuggaucggccugaacuccaagaacaccagcauguccuucagcugcaucgccaucgggaucaucacgcucuaccugggcgccgugguccaggccgacauggggugcgugaucaacuggaagggcaaggagcugaagugcggcuccgggaucuucgugaccaacgagguccacaccuggaccgagcaguacaaguuccaggcggacagccccaagcgccucgccacggccaucgccggcgccugggagaacggggugugcggcauccgcuccaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacagcuggaagaccugggggaaggccaagaucgucaccgccgagacgcagaacuccagcuucaucaucgacggccccaacacccccgagugccccuccgccagccgggcguggaacgugugggagguggaggacuacggguucggcgucuucaccaccaacaucuggcucaagcugcgcgagguguacacccagcugugcgaccaccggcucauguccgccgccgugaaggacgagcgcgccguccacgccgacaugggcuacuggaucgagagccagaagaacgggagcuggaagcuggagaaggcgucccugaucgaggugaagacgugcaccuggcccaagucccacacccucugguccaacggcgugcuggagagcgacaugaucauccccaagucccuggccgggcccaucagccagcacaaccaccggccgggcuaccacacccagacggccgggcccuggcaccucggcaagcuggagcuggacuucaacuacugcgagggcaccaccgucgugaucaccgagaacugcgggacgcgcggccccucccuccggaccaccaccgugagcgggaagcugauccacgaguggugcugccgcuccugcacgcugcccccgcuccgguacaugggcgaggacgggugcugguacggcauggagauccgccccaucagcgagaaggaggagaacauggucaagucccuggugagcgccggcuccgggaagguggacaacuucaccaugggcguccugugccucgccauccuguucgaggaggugaugcgggggaaguucggcaagaagcacaugaucgcggggguguucuucaccuucguccugcuccugagcggccagaucaccuggcgcgacauggcccacacgcugaucaugaucggcuccaacgccagcgaccggauggggaugggcgugaccuaccucgcccugaucgccaccuucaagauccagcccuuccuggcgcucggguucuuccugcgcaagcugaccucccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcagcaacaccaucuucacccugacggucgccuggcgcaccgccacccugauccucgcgggggugucccugcugccggucugccagagcuccagcaugcggaagaccgacuggcuccccaugacgguggccgccaugggcgugccgccccucccgcuguucaucuucucccucaaggacacccugaagcgccgcagcuggccccugaacgagggggucauggccgugggccucguguccauccuggccagcucccugcuccggaacgacguccccauggcgggcccccugguggccgggggccugcucaucgccugcuacgugaucaccgggaccagcgccgaccugacggucgagaaggccgcggacaucaccugggaggaggaggccgagcagaccggcgugucccacaaccugaugaucaccguggacgacgacgggaccaugcgcaucaaggacgacgagacggagaacauccucaccguccugcugaagaccgcccuccugaucgugagcggcaucuucccguacuccauccccgccacccugcucguguggcacacguggcagaagcagacccagcggagcggcguccugugggacgugcccagcccgcccgagacccagaaggccgagcuggaggaggggguguaccgcaucaagcagcagggcaucuucgggaagacccaggucggcgugggggugcagaaggagggcgucuuccacacgauguggcacgugacccggggcgcggugcucaccuacaacgggaagcgccuggagcccaacugggccagcgucaagaaggaccugaucuccuacggcgggggcuggcggcucagcgcccaguggaagaagggggaggagguccaggugaucgccgucgagcccggcaagaaccccaagaacuuccagaccaugcccggcacguuccagaccaccaccggggagaucggcgcgaucgcccuggacuucaagcccgggacguccggcagccccaucaucaaccgcgagggcaaggugguggggcuguacggcaacggggucgugaccaagaacggcggguacgugagcggcaucgcccagaccaacgccgagccggacggccccacccccgagcuggaggaggagauguucaagaagcggaaccucacgaucauggaccugcaccccggguccggcaagacccgcaaguaccugccggccaucguccgggaggcgaucaagcgccggcuccgcacccugauccuggcccccacccgggugguggccgccgagauggaggaggcccucaaggggcugcccauccgcuaccagacgaccgcgaccaagagcgagcacaccggccgggagaucgucgaccugaugugccacgccacguucaccaugcgccuccugucccccgugcgggugccgaacuacaaccugaucaucauggacgaggcccacuucaccgaccccgccagcaucgccgcgcgcggguacaucuccacccgggucggcaugggcgaggccgccgccaucuucaugacggcgacgccgcccgggaccgccgacgccuucccgcagagcaacgcccccauccaggacgaggagcgcgacauccccgagcgcuccuggaacagcggcaacgaguggaucaccgacuucgccgggaagacggugugguucgugcccuccaucaaggcgggcaacgacaucgccaacugccuccggaagaacgggaagaaggucauccagcugagccgcaagaccuucgacaccgaguaccagaagaccaagcugaacgacugggacuucguggugacgaccgacaucuccgagaugggcgccaacuucaaggccgaccgggucaucgacccgcgccggugccucaagcccgugauccugaccgacggccccgagcgcgugauccuggccgggcccaugccggucaccgcggccagcgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagagccggaagaccuucguggagcugaugcgccgcggggaccuccccgucuggcuggcgcacaagguggccuccgagggcaucaaguacaccgaccgcaaguggugcuucgacgggcagcggaacaaccagauccuggaggagaacauggacgucgagaucuggacgaaggagggcgagaagaagaagcuccgcccccgguggcuggacgcccgcaccuacagcgacccgcuggcccucaaggaguucaaggacuucgccgcgggccgcaaguccaucgcccuggaccuggugaccgagaucgggcgggugcccagccaccucgcccaccgcacccggaacgcccuggacaaccuggucaugcuccacacguccgagcacggcgggcgcgccuaccggcacgcgguggaggagcugcccgagaccauggagacccugcuccugcugggccucaugauccugcugaccgggggcgccaugcuguuccugaucagcggcaaggggaucggcaagacgagcaucgggcugaucugcgugaucgccuccagcggcaugcucuggauggccgagaucccgcugcaguggaucgccuccgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagaccacgaagcgggaccugggcaugagcaaggagccggggguggugucccccaccagcuaccuggacgucgaccuccaccccgccuccgccuggacccuguacgccguggcgaccacggugaucacccccaugcugcgccacaccaucgagaacagcaccgccaacgucucccucgccgccaucgccaaccaggcgguggugcugaugggccuggacaagggguggccgaucagcaagauggaccucggcgucccccugcuggcccucgggugcuacucccaggugaacccccugacgcugaccgccgccgugcuccugcugaucacccacuacgccaucaucggccccggccuccaggcgaaggccacccgggaggcccagaagcgcacggccgccgggaucaugaagaacccgaccgucgacggcaucaugaccaucgaccuggaccccgugaucuacgacagcaaguucgagaagcagcugggccaggugaugcuccugguccugugcgcggugcagcuccugcugaugcggaccuccugggcccucugcgaggcccugacgcuggccaccggccccaucaccacccucugggagggcagccccgggaaguucuggaacacgaccaucgcgguguccauggccaacaucuuccgcggcagcuaccuggccggggccggccuggccuucuccaucaugaaguccgucgggaccggcaagcggggcaccgggucccagggcgagacccucggggagaaguggaagaagaagcugaaccagcugagccgcaaggaguucgaccucuacaagaaguccggcaucacggagguggaccggaccgaggcgaaggaggggcugaagcgcggcgagaucacccaccacgccgugucccggggcagcgccaagcugcagugguucgucgagcgcaacauggugaucccggaggggcgggugaucgaccucggcugcgggcgcggcgggugguccuacuacugcgccggccugaagaaggucaccgaggugcggggcuacacgaagggcgggcccgggcacgaggagcccgugcccaugagcaccuacggcuggaacaucgucaagcugauguccgggaaggacguguucuaccucccgcccgagaagugcgacacccugcugugcgacaucggcgagagcucccccagccccaccguggaggagucccgcacgauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugagccgcaacuccacccacgagauguacuggaucagcaacggcaccgggaacaucguggccuccgucaacauggugagccggcuccugcugaaccgcuucacgaugacccaccggcgcccgaccaucgagaaggacguggaccucggcgcgggcacccggcacgucaacgccgagcccgagacgcccaacauggacgugaucggggagcgcaucaagcggaucaaggaggagcacaacuccaccuggcacuacgacgacgagaacccguacaagaccugggccuaccacggcagcuacgaggugaaggccaccggguccgccagcuccaugaucaacggcgucgugaagcugcugacgaagcccugggacgucgugcccauggugacccagauggcgaugaccgacaccacgcccuucgggcagcagcgcgucuucaaggagaagguggacacccggaccccgcgcagcaugcccggcacccggcgcgugaugggcaucacggccgaguggcucuggcggacccuggggcgcaacaagaagccccggcugugcacccgcgaggaguucaccaagaagguccgcacgaacgccgccaugggcgcgguguucaccgaggagaaccagugggacagcgccaaggccgccguggaggacgaggacuucuggaagcucgucgaccgggagcgcgagcugcacaagcuggggaagugcggcuccugcguguacaacaugauggggaagcgggagaagaagcucggcgaguucggcaaggccaaggggagccgcgcgaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgccauguacgccgacgacaccgcggggugggacacccgcaucacggaggacgaccugcacaacgaggagaagaucacccagcagauggacccggagcaccggcagcucgccaacgccaucuucaagcugaccuaccagaacaaggucgugaaggugcagcgccccacccccaccggcacggucauggacaucaucucccggaaggaccagcgcggcagcggccaggugggcaccuacgggcugaacaccuucaccaacauggaggcccagcucauccggcagauggagggcgagggggugcuguccaaggccgaccuggagaacccccaccucccggagaagaagaucacgcaguggcuggagaccaagggcgucgagcgccugaagcggauggcgaucagcggcgacgacugcguggugaagcccaucgacgaccgcuucgccaacgcccuccuggcccugaacgacauggggaagguccggaaggacaucccccaguggcagcccuccaagggcuggcacgacuggcagcaggucccguucugcagccaccacuuccacgagcucaucaugaaggacgggcgcaagcuggugguccccugccggccccaggacgagcugaucggccgcgcccggaucucccagggggcgggcuggagccuccgcgagaccgccugccugggcaaggccuacgcccagauguggucccugauguacuuccaccgccgggaccuccgccuggcgagcaacgccaucugcuccgccgugcccgugcacugggucccgaccagccggacgaccugguccauccacgcccaccaccaguggaugaccaccgaggacaugcugacgguguggaaccgcguguggaucgaggacaaccccuggauggaggacaagacccccgucaccaccugggagaacgugcccuaccucgggaagcgggaggaccaguggugcggcagccugaucgggcugacgagccgcgccaccugggcgcagaacaucccgaccgccauccagcagguccggucccucaucggcaacgaggaguuccuggacuacaugcccagcaugaagcgcuuccggaaggaggaggaguccgagggggccaucugguga

SEQ ID NO: 10077 - RNA, 9873 nt, Artificial Sequence
  derived and/or modified CDS sequence (opt1) from DENV-3__KJ189256__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcacggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucagccucaaggacacccugaagcgccgcuccuggccccugaacgagggggucauggccgugggccucgugagcauccuggcguccagccugcuccggaacgacguccccauggccggcccccugguggccgggggccugcucaucgccugcuacgugaucacggggaccuccgccgaccugaccgucgagaaggcggccgacaucaccugggaggaggaggccgagcagacgggcgugagccacaaccugaugaucaccguggacgacgacgggaccaugcgcaucaaggacgacgagaccgagaacauccucaccguccugcugaagacggcccuccugaucguguccggcaucuucccguacagcauccccgccacccugcucguguggcacaccuggcagaagcagacccagcgguccggcguccugugggacgugcccagcccgcccgagacgcagaaggcggagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggcgaucguccgggaggccaucaagcgccggcuccgcacgcugauccuggcccccacccgggugguggccgccgagauggaggaggcgcucaaggggcugcccauccgcuaccagaccaccgccacgaaguccgagcacaccggccgggagaucgucgaccugaugugccacgccaccuucaccaugcgccuccugagccccgugcgggugccgaacuacaaccugaucaucauggacgaggcccacuucacggaccccgccuccaucgcggcccgcggguacaucagcacccgggucggcaugggcgaggccgccgcgaucuucaugaccgccacgccgcccgggacggccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagacguucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggacuucgcggccggccgcaagagcaucgcccuggaccuggugacggagaucgggcgggugcccucccaccucgcccaccgcacccggaacgcccuggacaaccuggucaugcuccacaccagcgagcacggcgggcgcgcguaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucguccuggaguucuucaugauggugcuccugauccccgagcccgagaagcagcgcacgccccaggacaaccagcuggccuacguggucaucgggauccucacgcuggccgccaucaucgcggccaacgagaugggccugcucgagaccaccaagcgggaccugggcauguccaaggagccggggguggugagccccaccuccuaccuggacgucgaccuccaccccgccagcgccuggacgcuguacgcgguggccaccaccgugaucacccccaugcugcgccacacgaucgagaacuccaccgccaacgucagccucgccgccaucgcgaaccaggccguggugcugaugggccuggacaagggguggccgaucuccaagauggaccucggcgucccccugcuggcccucgggugcuacagccaggugaacccccugacccugaccgccgccgugcuccugcugaucacgcacuacgcgaucaucggccccggccuccaggccaaggccacccgggaggcccagaagcgcaccgccgcggggaucaugaagaacccgaccgucgacggcaucaugacgaucgaccuggaccccgugaucuacgacuccaaguucgagaagcagcugggccaggugaugcuccugguccugugcgccgugcagcuccugcugaugcggaccagcugggcccucugcgaggcccugacccuggcgaccggccccaucacgacccucugggagggcucccccgggaaguucuggaacaccaccaucgccgugagcauggccaacaucuuccgcggcuccuaccuggccggggccggccuggcguucagcaucaugaaguccgucgggacgggcaagcggggcaccgggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagaucacgcaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacgcacgagauguacuggaucuccaacggcaccgggaacaucguggcgagcgucaacauggugucccggcuccugcugaaccgcuucaccaugacccaccggcgcccgacgaucgagaaggacguggaccucggcgccggcacccggcacgucaacgccgagcccgagacccccaacauggacgugaucggggagcgcaucaagcggaucaaggaggagcacaacagcaccuggcacuacgacgacgagaacccguacaagacgugggccuaccacggcuccuacgaggugaaggccaccgggagcgcguccagcaugaucaacggcgucgugaagcugcugaccaagcccugggacgucgugcccauggugacccagauggccaugacggacaccacccccuucgggcagcagcgcgucuucaaggagaagguggacacccggacgccgcgcagcaugcccggcacccggcgcgugaugggcaucaccgccgaguggcucuggcggacccuggggcgcaacaagaagccccggcugugcacgcgcgaggaguucaccaagaagguccgcaccaacgccgcgaugggcgccguguucaccgaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgcggacgacacggccgggugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucagccggaaggaccagcgcggcuccggccaggugggcaccuacgggcugaacacguucaccaacauggaggcccagcucauccggcagauggagggcgagggggugcugagcaaggcggaccuggagaacccccaccucccggagaagaagaucacccaguggcuggagaccaagggcgucgagcgccugaagcggauggccaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcgcggaucagccagggggccggcuggucccuccgcgagacggccugccugggcaaggccuacgcgcagauguggagccugauguacuuccaccgccgggaccuccgccuggccuccaacgccaucugcagcgccgugcccgugcacugggucccgaccucccggaccaccuggagcauccacgcccaccaccaguggaugacgaccgaggacaugcugaccguguggaaccgcguguggaucgaggacaaccccuggauggaggacaagacccccgucacgaccugggagaacgugcccuaccucgggaagcgggaggaccaguggugcggcagccugaucgggcugaccucccgcgcgaccugggcccagaacaucccgacggccauccagcagguccggagccucaucggcaacgaggaguuccuggacuacaugcccuccaugaagcgcuuccggaaggaggaggagagcgagggggccaucugguga

SEQ ID NO: 10078 - RNA, 9873 nt, Artificial Sequence
  derived and/or modified CDS sequence (opt1) from DENV-3__KJ189257__SS-prME
accagccugugccucaugaugauccugcccgccgcccuggcguuccaccucaccagccgggacggggagccgcggaugaucguggggaagaacgagcggggcaagagccugcuguucaagacggccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcacggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacacguccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacaucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccggcguccugugggacgugcccagcccgcccgagacccagaaggccgagcuggaggaggggguguaccgcaucaagcagcagggcaucuucgggaagacccaggucggcgugggggugcagaaggagggcgucuuccacaccauguggcacgugacgcggggcgcggugcucaccuacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucguccgggaggcgaucaagcgccggcuccgcacccugauccuggcccccacccgggugguggccgccgagauggaggaggcccucaaggggcugcccauccgcuaccagaccacggcgaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggguacaucagcacccgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcgggugcccucccaccucgcccaccgcacccggaacgcccuggacaaccuggucaugcuccacaccagcgagcacggcgggcgcgccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagaccaccaagcgggaccugggcauguccaaggagccggggguggugagccccacguccuaccuggacgucgaccuccaccccgccagcgccuggacccuguacgccguggcgaccaccgugaucacgcccaugcugcgccacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugacggccgccguguuccuccugaucacccacuacgccaucaucggccccggccugcaggcgaaggccacccgggaggcccagaagcgcaccgccgccgggaucaugaagaacccgacggucgacggcaucaugaccaucgaccucgaccccgugaucuacgacuccaaguucgagaagcagcugggccaggugaugcugcucguccugugcgcggugcagcugcuccugaugcggaccagcugggcccugugcgaggcccucacccuggccacgggccccaucaccacccugugggagggcucccccgggaaguucuggaacaccacgaucgcggugagcauggccaacaucuuccgcggcuccuaccucgccggggccggccuggccuucagcaucaugaaguccgucgggaccggcaagcggggcaccgggagccagggcgagacccugggggagaaguggaagaagaagcucaaccagcugagccgcaaggaguucgaccuguacaagaaguccggcaucaccgagguggaccggacggaggcgaaggaggggcucaagcgcggcgagaucacccaccacgccgugagccggggcuccgccaagcugcagugguucgucgagcgcaacauggugaucccggaggggcgggugaucgaccugggcugcgggcgcggcggguggagcuacuacugcgccggccucaagaaggucaccgaggugcggggcuacaccaagggcgggcccgggcacgaggagcccgugcccauguccacguacggcuggaacaucgucaagcugaugagcgggaaggacguguucuaccugccgcccgagaagugcgacacccuccugugcgacaucggcgaguccagccccucccccaccguggaggagagccgcaccauccgcguccugaagaugguggagccguggcugaagaacaaccaguucugcaucaaggugcucaaccccuacaugcccacggucaucgagcaccuggagcggcugcagcgcaagcacggcgggaugcucgugcggaacccccugucccgcaacagcacccacgagauguacuggaucuccaacggcaccgggaacaucguggccagcgucaacauggugucccggcugcuccugaaccgcuucaccaugacgcaccggcgcccgaccaucgagaaggacguggaccugggcgcgggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcuccugaccaagcccugggacgucgugcccauggugacgcagauggcgaugaccgacaccacccccuucgggcagcagcgcgucuucaaggagaagguggacacgcggaccccgcgcagcaugcccggcacccggcgcgugaugggcaucaccgccgaguggcuguggcggacgcucgggcgcaacaagaagccccggcugugcacccgcgaggaguucaccaagaagguccgcaccaacgccgccaugggcgcgguguucacggaggagaaccagugggacuccgccaaggccgccguggaggacgaggacuucuggaagcuggucgaccgggagcgcgagcuccacaagcuggggaagugcggcagcugcguguacaacaugauggggaagcgggagaagaagcugggcgaguucggcaaggccaaggggucccgcgcgaucugguacauguggcucggcgcccgguaccuggaguucgaggcccugggguuccucaacgaggaccacugguucagccgcgagaacuccuacagcggcguggagggggagggccugcacaagcugggcuacauccuccgggacaucuccaagauccccgggggcgccauguacgccgacgacaccgcggggugggacacccgcaucaccgaggacgaccugcacaacgaggagaagaucacgcagcagauggacccggagcaccggcagcuggccaacgccaucuucaagcucaccuaccagaacaaggucgugaaggugcagcgccccacccccaccggcaccgucauggacaucaucagccggaaggaccagcgcggcuccggccaggugggcacguacgggcugaacaccuucaccaacauggaggcccagcugauccggcagauggagggcgagggggugcucagcaaggccgaccuggagaacccccaccuccccgagaagaagaucacccaguggcucgagacgaagggcgucgagcgccugaagcggauggcgaucuccggcgacgacugcguggugaagcccaucgacgaccgcuucgccaacgcccugcucgcccugaacgacauggggaagguccggaaggacaucccccaguggcagcccagcaagggcuggcacgacuggcagcaggucccguucugcucccaccacuuccacgagcugaucaugaaggacgggcgcaagcucgugguccccugccggccccaggacgagcugaucggccgcgcccggaucagccagggggcgggcuggucccugcgcgagaccgccugccucggcaaggccuacgcccagauguggagccugauguacuuccaccgccgggaccugcgccucgcguccaacgccaucugcagcgccgugcccgugcacugggucccgaccucccggaccacguggagcauccacgcccaccaccaguggaugaccaccgaggacaugcugaccguguggaaccgcguguggaucgaggacaaccccuggauggaggacaagacgcccgucaccaccugggagaacgugcccuaccuggggaagcgggaggaccaguggugcggcagccucaucgggcugaccucccgcgccacgugggcgcagaacaucccgaccgccauccagcagguccggagccugaucggcaacgaggaguuccucgacuacaugcccuccaugaagcgcuuccggaaggaggaggagagcgagggggccaucugguga

SEQ ID NO: 10079 - RNA, 9873 nt, Artificial Sequence
  derived and/or modified CDS sequence (opt1) from DENV-3__KJ189262__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcacggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucagccucaaggacacccugaagcgccgcuccuggccccugaacgagggggucauggccgugggccucgugagcauccuggcguccagccugcuccggaacgacguccccauggccggcccccugguggccgggggccugcucaucgccugcuacgugaucacggggaccuccgccgaccugaccgucgagaaggcggccgacaucaccugggaggaggaggccgagcagacgggcgugagccacaaccugaugaucaccguggacgacgacgggaccaugcgcaucaaggacgacgagaccgagaacauccucaccguccugcugaagacggcccuccugaucguguccggcaucuucccguacagcauccccgccacccugcucguguggcacaccuggcagaagcagacccagcgguccggcguccugugggacgugcccagcccgcccgagacgcagaaggcggagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccuccgucaagaaggaccugaucagcuacggcgggggcuggcggcucuccgcccaguggcagaagggggaggagguccaggugaucgcgaucgagcccggcaagaaccccaagaacuuccagaccaugcccggcaccuuccagaccacgaccggggagaucggcgccaucgcccuggacuucaagcccgggaccagcggcagccccaucaucaaccgcgagggcaaggucguggggcuguacggcaacgggguggucaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggcgaucgugcgggaggccaucaagcgccggcuccgcacgcugauccuggcccccacccgggucguggccgccgagauggaggaggcgcucaaggggcugcccauccgcuaccagaccaccgccacgaaguccgagcacaccggccgggagaucguggaccugaugugccacgccaccuucaccaugcgccuccugagccccguccgggugccgaacuacaaccugaucaucauggacgaggcccacuucacggaccccgccuccaucgcggcccgcggguacaucagcacccgggugggcaugggcgaggccgccgcgaucuucaugaccgccacgccgcccgggacggccgacgccuucccgcaguccaacgcccccauccaggacgaggagcgcgacauccccgagcgcagcuggaacuccggcaacgaguggaucaccgacuucgcggggaagaccgucugguucgugcccagcaucaaggccggcaacgacaucgccaacugccuccggaagaacgggaagaaggugauccagcugucccgcaagaccuucgacacggaguaccagaagaccaagcugaacgacugggacuucgucgugaccaccgacaucagcgagaugggcgccaacuucaaggccgaccgggugaucgacccgcgccggugccucaagcccgucauccugacggacggccccgagcgcgugauccuggcggggcccaugccggugaccgccgccuccgccgcccagcggcgcggccgggucgggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagacguucguggagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcccucaaggaguucaaggacuucgcggccggccgcaagagcaucgcccuggaccuggucacggagaucgggcgggugcccucccaccucgcccaccgcacccggaacgcccuggacaaccuggugaugcuccacaccagcgagcacggcgggcgcgcguaccggcacgccgucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucgugcuggaguucuucaugaugguccuccugauccccgagcccgagaagcagcgcacgccccaggacaaccagcuggccuacguggugaucgggauccucacgcuggccgccaucaucgcggccaacgagaugggccugcucgagaccaccaagcgggaccugggcauguccaaggagccgggggucgugagccccaccuccuaccuggacguggaccuccaccccgccagcgccuggacgcuguacgcggucgccaccaccgugaucacccccaugcugcgccacacgaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacccugaccgccgccgugcuccugcugaucacgcacuacgcgaucaucggccccggccuccaggccaaggccacccgggaggcccagaagcgcaccgccgcggggaucaugaagaacccgaccguggacggcaucaugacgaucgaccuggaccccgucaucuacgacuccaaguucgagaagcagcugggccaggugaugcuccuggugcugugcgccguccagcuccugcugaugcggaccagcugggcccucugcgaggcccugacccuggcgaccggccccaucacgacccucugggagggcucccccgggaaguucuggaacaccaccaucgccgugagcauggccaacaucuuccgcggcuccuaccuggccggggccggccuggcguucagcaucaugaaguccguggggacgggcaagcggggcaccgggagccagggcgagacccucggggagaaguggaagaagaagcugaaccagcugagccgcaaggaguucgaccucuacaagaaguccggcaucaccgaggucgaccggaccgaggccaaggaggggcugaagcgcggcgagaucacgcaccacgccgugagccggggcuccgccaagcugcagugguucguggagcgcaacauggucaucccggaggggcgggugaucgaccucggcugcgggcgcggcggguggagcuacuacugcgccggccugaagaaggugaccgagguccggggcuacaccaagggcgggcccgggcacgaggagcccgugcccauguccaccuacggcuggaacaucgugaagcugaugagcgggaaggacgucuucuaccucccgcccgagaagugcgacacgcugcugugcgacaucggcgaguccagccccucccccaccguggaggagagccgcaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugucccgcaacagcacgcacgagauguacuggaucuccaacggcaccgggaacaucguggcgagcgugaacauggucucccggcuccugcugaaccgcuucaccaugacccaccggcgcccgacgaucgagaaggacguggaccucggcgccggcacccggcacgugaacgccgagcccgagacccccaacauggacgucaucggggagcgcaucaagcggaucaaggaggagcacaacagcaccuggcacuacgacgacgagaacccguacaagacgugggccuaccacggcuccuacgaggugaaggccaccgggagcgcguccagcaugaucaacggcguggucaagcugcugaccaagcccugggacgugguccccauggugacccagauggccaugacggacaccacccccuucgggcagcagcgcguguucaaggagaaggucgacacccggacgccgcgcagcaugcccggcacccggcgcgugaugggcaucaccgccgaguggcucuggcggacccuggggcgcaacaagaagccccggcugugcacgcgcgaggaguucaccaagaaggugcgcaccaacgccgcgaugggcgccgucuucaccgaggagaaccagugggacuccgccaaggccgccguggaggacgaggacuucuggaagcucguggaccgggagcgcgagcugcacaagcuggggaagugcggcagcugcgucuacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgcggacgacacggccgggugggacacccgcaucaccgaggacgaccugcacaacgaggagaagaucacccagcagauggacccggagcaccggcagcucgccaacgccaucuucaagcugacguaccagaacaagguggucaaggugcagcgccccacccccaccggcaccgugauggacaucaucagccggaaggaccagcgcggcuccgggcaggucggcaccuacgggcugaacacguucaccaacauggaggcccagcucauccggcagauggagggcgagggggugcugagcaaggcggaccuggagaacccccaccucccggagaagaagaucacccaguggcuggagaccaagggcguggagcgccugaagcggauggccaucuccggcgacgacugcgucgugaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcgcggaucagccagggggccggcuggucccuccgcgagacggccugccugggcaaggccuacgcgcagauguggagccugauguacuuccaccgccgggaccuccgccuggccuccaacgccaucugcagcgccguccccgugcacugggugccgaccucccggaccaccuggagcauccacgcccaccaccaguggaugacgaccgaggacaugcugaccgucuggaaccgcguguggaucgaggacaaccccuggauggaggacaagacccccgugacgaccugggagaacguccccuaccucgggaagcgggaggaccaguggugcggcagccugaucgggcugaccucccgcgcgaccugggcccagaacaucccgacggccauccagcagguccggagccucaucggcaacgaggaguuccuggacuacaugcccuccaugaagcgcuuccggaaggaggaggagagcgagggggccaucugguga

SEQ ID NO: 10080 - RNA, 9873 nt, Artificial Sequence
  derived and/or modified CDS sequence (opt1) from DENV-3__KJ189263__SS-prME
accagccugugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccgugcucaucaaggucgaguacaagggcgaggacgugccgugcaagauccccuucagcacggaggacgggcacggcaaggcgcacaacggccgccugaucaccgccaaccccguggucaccaagaaggaggagcccgugaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacacggccugggacuucggguccgucggcggggugcucaacagccugggcaagauggugcaccagaucuucggguccgcguacaccgcccuguucagcggcgucuccugggugaugaagaucggcaucggggugcuccugaccuggaucggccugaacagcaagaacaccuccaugagcuucuccugcaucgccaucgggaucaucacgcucuaccugggcgccgucgugcaggccgacauggggugcgugaucaacuggaagggcaaggagcugaagugcggcagcgggaucuucgucaccaacgaggugcacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccgucguggugggggacaucaucggcguccucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgccucccgggcguggaacgugugggaggucgaggacuacggguucggcguguucaccaccaacaucuggcuccgccugcgggagguguacacccagcugugcgaccaccgccucaugagcgccgccgucaaggacgagcgggccgugcacgccgacaugggcuacuggaucgagagccagaagaacggguccuggaagcuggagaaggcgagccugaucgaggugaagacgugcaccuggccgaagucccacacccucuggagcaacggcguccuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggugaucaccgagaacugcgggacgcggggccccagccuccgcaccaccaccgucuccgggaagcugauccacgaguggugcugccggagcugcacgcugcccccgcuccgcuacaugggcgaggacgggugcugguacggcauggagauccggcccaucuccgagaaggaggagaacauggucaagagccugguguccgccggcagcgggaaggucgacaacuucaccaugggcgugcugugccucgccauccuguucgaggaggugaugcgcgggaaguucggcaagaagcacaugaucgcgggggucuucuucaccuucgugcugcuccuguccggccagaucaccuggcgggacauggcccacacgcugaucaugaucggcagcaacgccuccgaccgcauggggaugggcgugaccuaccucgcccugaucgccaccuucaagauccagcccuuccuggcgcucggguucuuccugcggaagcugaccagccgcgagaaccuccugcugggcgucggccucgccauggccacgacccugcagcugcccgaggacaucgagcagauggccaacgggaucgcgcucggccugauggcccugaagcucaucacccaguucgagaucuaccagcuguggaccgcccugaucagccucacgugcuccaacaccaucuucacccugaccguggccuggcggacggccacccugauccucgcgggggucagccugcugccggugugccaguccagcuccaugcgcaagaccgacuggcuccccauggccguggccgccaugggcgugccgccccucccgcuguucaucuucagccucaaggacacccugaagcgccgguccuggccccugaacgagggggugauggccgugggccucgucagcauccuggcguccagccugcuccgcaacgacgugcccauggccggcccccugguggccgggggccugcucaucgccugcuacgucaucacggggaccuccgccgaccugaccguggagaaggcggccgacaucaccugggaggaggaggccgagcagacgggcgugagccacaaccugaugaucaccgucgacgacgacgggaccaugcggaucaaggacgacgagaccgagaacauccucaccgugcugcugaagacggcccuccugaucguguccggcaucuucccguacagcauccccgccacccugcucgucuggcacaccuggcagaagcagacccagcgcuccggcgugcugugggacgugcccagcccgcccgagacgcagaaggcggagcuggaggagggggucuaccggaucaagcagcagggcaucuucgggaagacccaggugggcguggggguccagaaggagggcguguuccacaccauguggcacgugacccgcggcgccguccucacguacaacgggaagcggcuggagcccaacugggccuccgugaagaaggaccugaucagcuacggcgggggcuggcgccucuccacccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgggagggcaagguggucgggcuguacggcaacgggguggugacgaagaacggcggguacgucuccggcaucgcccagaccaacgccgagccggacggccccacccccgagcuggaggaggagauguucaagaagcgcaaccucaccaucauggaccugcaccccgggagcggcaagacgcggaaguaccugccggccaucgugcgcgaggcgaucaagcggcgccuccggacccugauccuggcccccacccgcguggucgccgccgagauggaggaggcccucaaggggcugcccauccgguaccagaccacggcgaccaaguccgagcacaccggccgcgagaucguggaccugaugugccacgccaccuucacgaugcggcuccugagccccgugcgcgucccgaacuacaaccugaucaucauggacgaggcccacuucaccgaccccgccuccaucgccgcgcggggguacaucagcacccgcgugggcaugggcgaggccgccgccaucuucaugaccgcgacgccgcccgggaccgccgacgccuucccgcaguccaacgcccccauccaggacgaggagcgcgacauccccgagcggagcuggaacuccggcaacgaguggaucaccgacuucgccgggaagaccgugugguucguccccagcaucaaggcgggcaacgacaucgccaacugccuccgcaagaacgggaagaaggugauccagcugucccggaagacguucgacaccgaguaccagaagaccaagcugaacgacugggacuucguggucaccacggacaucagcgagaugggcgccaacuucaaggccgaccgcgugaucgacccgcggcgcugccucaagcccgugauccugaccgacggccccgagcgggucauccuggccgggcccaugccggugaccgcggccuccgccgcccagcgccggggccgcguggggcggaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgcgagaaguccgccgccaucgacggcgaguaccggcugaagggcgagucccgcaagaccuucgucgagcugaugcggcgcggggaccuccccguguggcuggcgcacaaggucgccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcacguacuccgacccgcuggcccucaaggaguucaaggacuucgccgcgggccgcaagagcaucgcccuggaccuggugaccgagaucgggcgcguccccucccaccucgcccaccggacccgcaacgcccuggacaaccuggugaugcuccacaccagcgagcacggcgggcgggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccaccaagcgcgaccugggcauguccaaggagccggggguggucagccccacguccuaccuggacguggaccuccaccccgccagcgccuggacccuguacgccguggcgaccaccgucaucacgcccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgcgaggcccagaagcggaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacccuggccacgggccccaucaccacccucugggagggcucccccgggaaguucuggaacaccacgaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgagguggaccgcacggaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccgcaccauccgggugcugaagaugguggagccguggcucaagaacaaccaguucugcaucaagguccugaaccccuacaugcccacggugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucaccaugacgcaccgccggccgaccaucgagaaggacgucgaccucggcgcgggcacccgccacgugaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcggguguucaaggagaagguggacacgcgcaccccgcggagcaugcccggcacccgccgggucaugggcaucaccgccgaguggcucuggcgcacgcuggggcggaacaagaagccccgccugugcacccgcgaggaguucaccaagaaggugcggaccaacgccgccaugggcgcgguguucacggaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucagccgcaaggaccagcggggcuccggccaggugggcacguacgggcugaacaccuucaccaacauggaggcccagcucauccgccagauggagggcgaggggguccugagcaaggccgaccuggagaacccccaccucccggagaagaagaucacccaguggcuggagacgaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccuccgcgagaccgccugccugggcaaggccuacgcccagauguggagccugauguacuuccaccggcgcgaccuccggcuggcguccaacgccaucugcagcgccgugcccguccacugggugccgaccucccgcaccacguggagcauccacgcccaccaccaguggaugaccaccgaggacaugcugaccguguggaaccgggucuggaucgaggacaaccccuggauggaggacaagacgcccgugaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10081 - RNA, 9873 nt, Artificial Sequence
  derived and/or modified CDS sequence (opt1) from DENV-3__KJ189265__SS-prME
accagccucugccucaugaugauccugcccgccgcccuggcguuccaccucaccagccgggacggggagccccggaugaucguggggaagaacgagcggggcaagagccugcuguucaagacggccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcacggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcacggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacacguccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccauggcgguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcgaacaucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccggcguccugugggacgugcccagcccgcccgagacccagaaggccgagcuggaggaggggguguaccgcaucaagcagcagggcaucuucgggaagacccaggucggcgugggggugcagaaggagggcgucuuccacaccauguggcacgugacgcggggcgcggugcucaccuacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucguccgggaggcgaucaagcgccggcuccgcacccugauccuggcccccacccgggugguggccgccgagauggaggaggcccucaaggggcugcccauccgcuaccagaccacggcgaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggguacaucagcacccgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcgggugcccucccaccucgcccaccgcacccggaacgcccuggacaaccuggucaugcuccacaccagcgagcacggcgggcgcgccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagaccaccaagcgggaccugggcauguccaaggagccggggguggugagccccacguccuaccuggacgucgaccuccaccccgccagcgccuggacccuguacgccguggcgaccaccgugaucacgcccaugcugcgccacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugacggccgccgugcuccugcugaucacccacuacgccaucaucggccccggccuccaggcgaaggccacccgggaggcccagaagcgcaccgccgccgggaucaugaagaacccgacggucgacggcaucaugaccaucgaccuggaccccgugaucuacgacuccaaguucgagaagcagcugggccaggugaugcuccugguccugugcgcggugcagcuccugcugaugcggaccagcugggcccucugcgaggcccugacccuggccacgggccccaucaccacccucugggagggcucccccgggaaguucuggaacaccacgaucgcggugagcauggccaacaucuuccgcggcuccuaccuggccggggccggccuggccuucagcaucaugaaguccgucgggaccggcaagcggggcaccgggagccagggcgagacccucggggagaaguggaagaagaagcugaaccagcugagccgcaaggaguucgaccucuacaagaaguccggcaucaccgagguggaccggacggaggcgaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccgcaccauccgcguccugaagaugguggagccguggcucaagaacaaccaguucugcaucaaggugcugaaccccuacaugcccacggucaucgagcaccuggagcggcuccagcgcaagcacggcgggaugcuggugcggaacccccugucccgcaacagcacccacgagauguacuggaucuccaacggcaccgggaacaucguggccagcgucaacauggugucccggcuccugcugaaccgcuucaccaugacgcaccggcgcccgaccaucgagaaggacguggaccucggcgcgggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgucgugcccauggugacgcagauggcgaugaccgacaccacccccuucgggcagcagcgcgucuucaaggagaagguggacacgcggaccccgcgcagcaugcccggcacccggcgcgugaugggcaucaccgccgaguggcucuggcggacgcuggggcgcaacaagaagccccggcugugcacccgcgaggaguucaccaagaagguccgcaccaacgccgccaugggcgcgguguucacggaggagaaccagugggacuccgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcccagcucauccggcagauggagggcgagggggugcugagcaaggccgaccuggagaacccccaccucccggagaagaagaucacccaguggcuggagacgaagggcgucgagcgccugaagcggauggcgaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggcgggcuggucccuccgcgagaccgccugccugggcaaggccuacgcccagauguggagccugauguacuuccaccgccgggaccuccgccuggcguccaacgccaucugcagcgccgugcccgugcacugggucccgaccucccggaccacguggagcauccacgcccaccaccaguggaugaccaccgaggacaugcugaccguguggaaccgcguguggaucgaggacaaccccuggauggaggacaagacgcccgucaccaccugggagaacgugcccuaccucgggaagcgggaggaccaguggugcggcagccugaucgggcugaccucccgcgccacgugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 10082 - RNA, 9873 nt, Artificial Sequence
  derived and/or modified CDS sequence (opt1) from DENV-3__KJ189266__SS-prME
accagccugugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcacggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccauggccguggccgccaugggcgugccgccccucccgcuguucaucuucagccucaaggacacccugaagcgccgcuccuggccccugaacgagggggucauggccgugggccucgugagcauccuggcguccagccugcuccggaacgacguccccauggccggcccccugguggccgggggccugcucaucgccugcuacgugaucacggggaccuccgccgaccugaccgucgagaaggcggccgacaucaccugggaggaggaggccgagcagacgggcgugagccacaaccugaugaucaccguggacgacgacgggaccaugcgcaucaaggacgacgagaccgagaacauccucaccguccugcugaagacggcccuccugaucguguccggcaucuucccguacagcauccccgccacccugcucguguggcacaccuggcagaagcagacccagcgguccggcguccugugggacgugcccagcccgcccgagacgcagaaggcggagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccuccgucaagaaggaccugaucagcuacggcgggggcuggcggcucuccgcccaguggcagaagggggaggagguccaggugaucgcgaucgagcccggcaagaaccccaagaacuuccaggccaugcccggcaccuuccagaccaccacgggggagaucggcgccaucgcccuggacuucaagcccgggaccagcggcagccccaucaucaaccgcgagggcaaggucguggggcuguacggcaacgggguggucaccaagaacggcggguacguguccggcaucgcccagaccaacgcggagccggacggccccacgcccgagcuggaggaggagauguucaagaagcggaaccucaccaucauggaccugcaccccgggagcggcaagacccgcaaguaccugccggccaucgugcgggaggccaucaagcgccggcuccgcacccugauccuggcccccacgcgggucguggccgcggagauggaggaggcccucaaggggcugcccauccgcuaccagaccaccgccaccaaguccgagcacacgggccgggagaucguggaccugaugugccacgccaccuucaccaugcgccuccugagccccguccgggugccgaacuacaaccugaucaucauggacgaggcccacuucaccgaccccgcguccaucgccgcccgcggguacaucagcacgcgggugggcaugggcgaggccgcggccaucuucaugaccgccacgccgcccgggaccgccgacgccuucccgcaguccaacgcgcccauccaggacgaggagcgcgacauccccgagcgcagcuggaacuccggcaacgaguggaucacggacuucgccgggaagaccgucugguucgugcccagcaucaaggccggcaacgacaucgccaacugccuccggaagaacgggaagaaggugauccagcugucccgcaagaccuucgacaccgaguaccagaagacgaagcugaacgacugggacuucgucgugaccaccgacaucagcgagaugggcgccaacuucaaggcggaccgggugaucgacccgcgccggugccucaagcccgucauccugaccgacggccccgagcgcgugauccuggccgggcccaugccggugacggccgccuccgccgcgcagcggcgcggccgggucgggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagucccggaagaccuucguggagcugaugcgccgcggggaccuccccguguggcuggcccacaaggucgccagcgagggcaucaaguacacggaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcgcucaaggaguucaaggacuucgccgccggccgcaagagcaucgcccuggaccuggucaccgagaucgggcgggugcccucccaccucgcccaccgcacgcggaacgcgcuggacaaccuggugaugcuccacaccagcgagcacggcgggcgcgccuaccggcacgccgucgaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugcucuggauggcggagaucccgcugcaguggaucgccagcgccaucgugcuggaguucuucaugaugguccuccugauccccgagcccgagaagcagcgcacgccccaggacaaccagcuggccuacguggugaucgggauccucacccuggccgcgaucaucgccgccaacgagaugggccugcucgagacgaccaagcgggaccugggcauguccaaggagccgggggucgugagccccaccuccuaccuggacguggaccuccaccccgccagcgcguggacccuguacgccgucgccacgaccgugaucacccccaugcugcgccacaccaucgagaacuccacggccaacgugagccucgccgcgaucgccaaccaggccgucgugcugaugggccuggacaagggguggccgaucuccaagauggaccucggcgugccccugcuggcccucgggugcuacagccaggucaacccccugacccugaccgccgcggugcuccugcugaucacccacuacgccaucaucggccccggccuccaggccaaggccacgcgggaggcccagaagcgcaccgcggccgggaucaugaagaacccgaccguggacggcaucaugaccaucgaccuggaccccgucaucuacgacuccaaguucgagaagcagcugggccaggugaugcuccuggugcugugcgccguccagcuccugcugaugcggacgagcugggcccucugcgaggcgcugacccuggccaccggccccaucaccacgcucugggagggcucccccgggaaguucuggaacaccaccaucgccgugagcauggccaacaucuuccgcggcuccuaccuggccggggcgggccuggccuucagcaucaugaaguccguggggaccggcaagcggggcacggggagccagggcgagacccucggggagaaguggaagaagaagcugaaccagcugagccgcaaggaguucgaccucuacaagaaguccggcaucaccgaggucgaccggaccgaggccaaggaggggcugaagcgcggcgagaucacccaccacgccgugagccggggcuccgccaagcugcagugguucguggagcgcaacauggucaucccggaggggcgggugaucgaccucggcugcgggcgcggcggguggagcuacuacugcgcgggccugaagaaggugacggagguccggggcuacaccaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccacgguggaggagagccgcaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugucccgcaacagcacccacgagauguacuggaucuccaacggcacggggaacaucguggccagcgugaacauggucucccggcuccugcugaaccgcuucaccaugacccaccggcgcccgaccaucgagaaggacguggaccucggcgccggcacgcggcacgugaacgccgagcccgagacccccaacauggacgucaucggggagcgcaucaagcggaucaaggaggagcacaacagcaccuggcacuacgacgacgagaacccguacaagaccugggccuaccacggcuccuacgaggugaaggcgacggggagcgccuccagcaugaucaacggcguggucaagcugcugaccaagcccugggacgugguccccauggugacccagauggccaugaccgacacgacccccuucgggcagcagcgcguguucaaggagaaggucgacacccggaccccgcgcagcaugcccggcacgcggcgcgugaugggcaucaccgccgaguggcucuggcggacccuggggcgcaacaagaagccccggcugugcacccgcgaggaguucacgaagaaggugcgcaccaacgcggccaugggcgccgucuucaccgaggagaaccagugggacuccgccaaggccgcgguggaggacgaggacuucuggaagcucguggaccgggagcgcgagcugcacaagcuggggaagugcggcagcugcgucuacaacaugauggggaagcgggagaagaagcucggcgaguucggcaaggccaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgcgauguacgccgacgacaccgccgggugggacacgcgcaucaccgaggacgaccugcacaacgaggagaagaucacccagcagauggacccggagcaccggcagcucgccaacgccaucuucaagcugaccuaccagaacaagguggucaaggugcagcgccccacgcccaccggcaccgugauggacaucaucagccggaaggaccagcgcggcuccgggcaggucggcaccuacgggcugaacaccuucacgaacauggaggcgcagcucauccggcagauggagggcgagggggugcugagcaaggccgaccuggagaacccccaccucccggagaagaagaucacccaguggcuggagaccaagggcguggagcgccugaagcggauggccaucuccggcgacgacugcgucgugaagcccaucgacgaccgcuucgccaacgcccuccuggcgcugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcccggaucagccagggggccggcuggucccuccgcgagaccgccugccugggcaaggcguacgcccagauguggagccugauguacuuccaccgccgggaccuccgccuggccuccaacgccaucugcagcgccguccccgugcacugggugccgacgucccggaccaccuggagcauccacgcgcaccaccaguggaugaccacggaggacaugcugaccgucuggaaccgcguguggaucgaggacaaccccuggauggaggacaagacccccgugaccacgugggagaacguccccuaccucgggaagcgggaggaccaguggugcggcagccugaucgggcugaccucccgcgccaccugggcccagaacaucccgaccgccauccagcagguccggagccucaucggcaacgaggaguuccuggacuacaugcccuccaugaagcgcuuccggaaggaggaggagagcgagggggccaucugguga

SEQ ID NO: 10083 - RNA, 9873 nt, Artificial Sequence
  derived and/or modified CDS sequence (opt1) from DENV-3__KJ189268__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcuccgccugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggucaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgcgauccuguucgaggaggucaugcgcgggaaguucggcaagaagcacaugaucgccgggguguucuucaccuucgugcugcuccuguccggccagaucaccuggcgggacauggcccacacgcugaucaugaucggcagcaacgccuccgaccgcauggggaugggcgucaccuaccucgcccugaucgcgaccuucaagauccagcccuuccuggcccucggguucuuccugcggaagcugaccagccgcgagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccaucuucacccugacgguggccuggcggaccgcgacccugauccucgccggggucagccugcugccggugugccaguccagcuccaugcgcaagaccgacuggcuccccauggccgucgccgccaugggcgugccgccccucccgcuguucaucuucagccucaaggacacgcugaagcgccgguccuggccccugaacgagggggugauggcggucggccucgugagcauccuggccuccagccugcuccgcaacgacgugcccauggccggcccccuggucgccgggggccugcucaucgccugcuacgugaucaccgggaccuccgcggaccugaccguggagaaggccgccgacaucacgugggaggaggaggccgagcagaccggcgucagccacaaccugaugaucaccguggacgacgacgggaccaugcggaucaaggacgacgagaccgagaacauccucacggugcugcugaagaccgcccuccugaucgucuccggcaucuucccguacagcauccccgcgacccugcucguguggcacaccuggcagaagcagacgcagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgccgugcucaccuacaacgggaagcggcuggagcccaacugggccuccgugaagaaggaccugaucagcuacggcgggggcuggcgccucuccacccaguggcagaagggggaggagguccaggugaucgcgguggagcccggcaagaaccccaagaacuuccagaccaugcccggcacguuccagaccaccaccggggagaucggcgccaucgcccuggacuucaagcccgggacgagcggcagccccaucaucaaccgggagggcaaggucguggggcuguacggcaacgggguggucaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggcgaucgugcgcgaggccaucaagcggcgccuccggacccugauccuggcccccacccgcgucguggccgccgagauggaggaggcgcucaaggggcugcccauccgguaccagacgaccgccaccaaguccgagcacaccggccgcgagaucguggaccugaugugccacgccacguucaccaugcggcuccugagccccguccgcgugccgaacuacaaccugaucaucauggacgaggcccacuucaccgaccccgccuccaucgcggcccggggguacaucagcacccgcgugggcaugggcgaggccgccgcgaucuucaugacggccacgccgcccgggaccgccgacgccuucccgcaguccaacgcccccauccaggacgaggagcgcgacauccccgagcggagcuggaacuccggcaacgaguggaucaccgacuucgcggggaagacggucugguucgugcccagcaucaaggccggcaacgacaucgccaacugccuccgcaagaacgggaagaaggugauccagcugucccggaagaccuucgacaccgaguaccagaagaccaagcugaacgacugggacuucgucgugacgaccgacaucagcgagaugggcgccaacuucaaggccgaccgcgugaucgacccgcggcgcugccucaagcccgucauccugaccgacggccccgagcgggugauccuggcggggcccaugccggugaccgccgccuccgccgcccagcgccggggccgcgucgggcggaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgcgagaaguccgccgcgaucgacggcgaguaccggcugaagggcgagucccgcaagaccuucguggagcugaugcggcgcggggaccuccccguguggcuggcccacaaggucgccagcgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacuccgacccgcuggcccucaaggaguucaaggacuucgcggccggccgcaagagcaucgcccuggaccuggucaccgagaucgggcgcgugcccucccaccucgcccaccggaccaagaacgcccuggacaaccuggugaugcuccacacgagcgagcacggcgggcgcgcguaccggcacgccgucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucgugcuggaguucuucaugaugguccuccugauccccgagcccgagaagcagcgcacgccccaggacaaccagcuggccuacguggugaucgggauccucacccuggccgccaccaucgcggccaacgagaugggccugcucgagacgaccaagcgggaccugggcauguccaaggagccgggggucgugagccccaccuccuaccuggacguggaccuccaccccgccagcgccuggacccuguacgcggucgccacgaccgugaucacccccaugcugcgccacaccaucgagaacuccacggccaacgugagccucgccgccaucgcgaaccaggccgucgugcugaugggccuggacaagggguggccgaucuccaagauggaccucggcgugccccugcuggcccucgggugcuacagccaggucaacccccugacccugaccgccgccgugcuccugcugaucacccacuacgcgaucaucggccccggccuccaggccaaggccacgcgggaggcccagaagcgcaccgccgcggggaucaugaagaacccgaccguggacggcaucaugaccaucgaccuggaccccgucaucuacgacuccaaguucgagaagcagcugggccaggugaugcuccuggugcugugcgccguccagcuccugcugaugcggacgagcugggcccucugcgaggcccugacccuggcgaccggccccaucaccacgcucugggagggcucccccgggaaguucuggaacaccaccaucgccgugagcauggccaacaucuuccgcggcuccuaccuggccggggccggccuggcguucagcaucaugaaguccguggggaccggcaagcggggcaccgggagccagggcgagacgcucggggagaaguggaagaagaagcugaaccagcugagccgcaaggaguucgaccucuacaagaaguccggcaucaccgaggucgaccggaccgaggccaaggaggggcugaagcgcggcgagaucacccaccacgccgugagccggggcuccgccaagcugcagugguucguggagcgcaacauggucaucccggaggggcgggugaucgaccucggcugcgggcgcggcggguggagcuacuacugcgccggccugaagaaggugacggagguccggggcuacaccaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccacgguggaggagagccgcaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugucccgcaacagcacccacgagauguacuggaucuccaacggcacggggaacaucguggcgagcgugaacauggucucccggcuccugcugaaccgcuucaccaugacccaccggcgcccgaccaucgagaaggacguggaccucggcgccggcacgcggcacgugaacgccgagcccgagacccccaacauggacgucaucggggagcgcaucaagcggaucaaggaggagcacaacagcaccuggcacuacgacgacgagaacccguacaagaccugggccuaccacggcuccuacgaggugaaggccacggggagcgcguccagcaugaucaacggcguggucaagcugcugaccaagcccugggacgugguccccauggugacccagauggccaugaccgacacgacccccuucgggcagcagcgcguguucaaggagaaggucgacacccggaccccgcgcagcaugcccggcacgcggcgcgugaugggcaucaccgccgaguggcucuggcggacccuggggcgcaacaagaagccccggcugugcacccgcgaggaguucacgaagaaggugcgcaccaacgccgcgaugggcgccgucuucaccgaggagaaccagugggacuccgccaaggccgccguggaggacgaggacuucuggaagcucguggaccgggagcgcgagcugcacaagcuggggaagugcggcagcugcgucuacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgcggacgacaccgccgggugggacacgcgcaucaccgaggacgaccugcacaacgaggagaagaucacccagcagauggacccggagcaccggcagcucgccaacgccaucuucaagcugaccuaccagaacaagguggucaaggugcagcgccccacccccacgggcaccgugauggacaucaucagccggaaggaccagcgcggcuccgggcaggucggcaccuacgggcugaacaccuucacgaacauggaggcccagcucauccggcagauggagggcgagggggugcugagcaaggcggaccuggagaacccccaccucccggagaagaagaucacccaguggcuggagaccaagggcguggagcgccugaagcggauggccaucuccggcgacgacugcgucgugaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcgcggaucagccagggggccggcuggucccuccgcgagaccgccugccugggcaaggccuacgcgcagauguggagccugauguacuuccaccgccgggaccuccgccuggccuccaacgccaucugcagcgccguccccgugcacugggugccgacgucccggaccaccuggagcauccacgcccaccaccaguggaugaccacggaggacaugcugaccgucuggaaccgcguguggaucgaggacaaccccuggauggaggacaagacccccgugaccacgugggaggacguccccuaccucgggaagcgggaggaccaguggugcggcagccugaucgggcugaccucccgcgcgaccugggcccagaacaucccgaccgccauccagcagguccggagccucaucggcaacgaggaguuccuggacuacaugcccuccaugaagcgcuuccggaaggaggaggagagcgagggggccaucugguga

SEQ ID NO: 10084 - RNA, 9873 nt, Artificial Sequence
  derived and/or modified CDS sequence (opt1) from DENV-3__KJ189271__SS-prME
accagccugugccucaugaugauccugcccgccgcccuggcguuccaccucaccagccgggacggggagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcuccgccugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggucaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgcgauccuguucgaggaggucaugcgcgggaagcugggcaagaagcacaugaucgccgggguguucuucaccuucgugcuccugcuguccggccagaucaccuggcgggacauggcccacacgcucaucaugaucggcagcaacgccuccgaccgcauggggaugggcgucaccuaccuggcccugaucgcgaccuucaagauccagcccuuccucgcccugggguucuuccugcggaagcucaccagccgcgagaaccugcugcucggcgugggccuggccauggccacgacccugcagcuccccgaggacaucgagcagauggcgaacgggaucgcccugggccugauggcccucaagcugaucacccaguucgagaccuaccagcuguggacggcccucaucagccugaccugcuccaacaccaucuucacccugacgguggccuggcggaccgcgacccucauccuggccggggucagccugcucccggugugccaguccagcuccaugcgcaagaccgacuggcugcccauggccgucgccgccaugggcgugccgccccugccccuguucaucuucagccugaaggacacgcugaagcgccgguccuggccccucaacgagggggugauggcggucggccuggugagcauccuggccuccagccuccugcgcaacgacgugcccauggccggcccccuggucgccgggggccuccugaucgccugcuacgugaucaccgggaccuccgcggaccugaccguggagaaggccgccgacaucacgugggaggaggaggccgagcagaccggcgucagccacaaccucaugaucaccguggacgacgacgggaccaugcggaucaaggacgacgagaccgagaacauccugacggugcugcucaagaccgcccugcugaucgucuccggcaucuucccguacagcauccccgcgacccuccugguguggcacaccuggcagaagcagacgcagcgcuccggcgugcugugggacguccccagcccgcccgagacccagaaggccgagcucgaggaggggguguaccggaucaagcagcagggcaucuucgggaagacccaggugggcgucggggugcagaaggagggcguguuccacaccauguggcacgucacgcgcggcgccgugcugaccuacaacgggaagcggcuggagcccaacugggccuccgugaagaaggaccucaucagcuacggcgggggcuggcgccuguccacccaguggcagaagggggaggagguccaggugaucgcgguggagcccggcaagaaccccaagaacuuccagaccaugcccggcacguuccagaccaccaccggggagaucggcgccaucgcccuggacuucaagcccgggacgagcggcagccccaucaucaaccgggagggcaaggucguggggcuguacggcaacgggguggucaccaagaacggcggguacguguccggcaucgcccagaccaacgccgagccggacggccccacccccgagcucgaggaggagauguucaagaagcgcaaccugacgaucauggaccugcaccccgggagcggcaagacccggaaguaccucccggcgaucgugcgcgaggccaucaagcggcgccugcggacccugauccucgcccccacccgcgucguggccgccgagauggaggaggcgcugaaggggcugcccauccgguaccagacgaccgccaccaaguccgagcacaccggccgcgagaucguggaccucaugugccacgccacguucaccaugcggcugcugagccccguccgcgugccgaacuacaaccucaucaucauggacgaggcccacuucaccgaccccgccuccaucgcggcccggggguacaucagcacccgcgugggcaugggcgaggccgccgcgaucuucaugacggccacgccgcccgggaccgccgacgccuucccgcaguccaacgcccccauccaggacgaggagcgcgacauccccgagcggagcuggaacuccggcaacgaguggaucaccgacuucgcggggaagacggucugguucgugcccagcaucaaggccggcaacgacaucgccaacugccugcgcaagaacgggaagaaggugauccagcugucccggaagaccuucgacaccgaguaccagaagaccaagcucaacgacugggacuucgucgugacgaccgacaucagcgagaugggcgccaacuucaaggccgaccgcgugaucgacccgcggcgcugccugaagcccgucauccugaccgacggccccgagcgggugauccucgcggggcccaugccggugaccgccgccuccgccgcccagcgccggggccgcgucgggcggaacccccagaaggagaacgaccaguacaucuucaccggccagccccugaacaacgacgaggaccacgcgcacuggacggaggccaagaugcugcucgacaacaucaacacccccgaggggaucaucccggcccuguucgagcccgagcgcgagaaguccgccgcgaucgacggcgaguaccggcugaagggcgagucccgcaagaccuucguggagcucaugcggcgcggggaccugcccguguggcuggcccacaaggucgccagcgagggcaucaaguacaccgaccggaaguggugcuucgacgggcagcgcaacaaccagauccucgaggagaacauggacguggagaucuggacgaaggagggcgagaagaagaagcugcggccccgcuggcuggacgcccgcaccuacuccgacccgcucgcccugaaggaguucaaggacuucgcggccggccgcaagagcaucgcccuggaccucgucaccgagaucgggcgcgugcccucccaccuggcccaccggacccgcaacgcccuggacaaccucgugaugcugcacacgagcgagcacggcgggcgggcguaccgccacgccgucgaggagcugcccgagaccauggagacccuccugcugcucggccugaugauccugcucaccgggggcgccaugcuguuccugaucagcggcaaggggaucggcaagacguccaucgggcucaucugcgugaucgccagcuccggcaugcuguggauggccgagaucccgcugcaguggaucgcgagcgccaucgugcucgaguucuucaugaugguccugcugauccccgagcccgagaagcagcggacgccccaggacaaccagcucgccuacguggugaucgggauccugacccuggccgccaucaucgcggccaacgagaugggccuccuggagaccacgaagcgcgaccugggcauguccaaggagccgggggucgugagccccaccuccuaccucgacguggaccugcaccccgccagcgccuggacccuguacgcggucgccaccacggugaucacccccaugcuccggcacaccaucgagaacuccaccgccaacgugagccuggccgccaucgcgaaccaggccgucgugcugaugggccucgacaagggguggccgaucuccaagauggaccugggcgugccccugcucgcccuggggugcuacagccaggucaacccccugacgcucaccgccgccgugcugcugcucaucacccacuacgcgaucaucggccccggccugcaggccaaggccacccgcgaggcccagaagcggacggccgcggggaucaugaagaacccgaccguggacggcaucaugaccaucgaccuggaccccgucaucuacgacuccaaguucgagaagcagcucggccaggugaugcugcuggugcucugcgccguccagcugcugcucaugcgcaccagcugggcccugugcgaggcccugacgcucgcgaccggccccaucaccacccugugggagggcucccccgggaaguucuggaacacgaccaucgccgugagcauggccaacaucuuccggggcuccuaccuggccggggccggccucgcguucagcaucaugaaguccguggggaccggcaagcgcggcaccgggagccagggcgagacccugggggagaaguggaagaagaagcugaaccagcucagccggaaggaguucgaccuguacaagaaguccggcaucacggaggucgaccgcaccgaggccaaggaggggcugaagcggggcgagaucacccaccacgccgugagccgcggcuccgccaagcuccagugguucguggagcggaacauggucaucccggaggggcgcgugaucgaccugggcugcgggcggggcggguggagcuacuacugcgccggccugaagaaggugaccgagguccgcggcuacacgaagggcgggcccgggcacgaggagcccgugcccauguccaccuacggcuggaacaucgugaagcucaugagcgggaaggacgucuucuaccugccgcccgagaagugcgacacccugcugugcgacaucggcgaguccagccccucccccaccguggaggagagccgcacgauccgggugcucaagauggucgagccguggcugaagaacaaccaguucugcaucaaggugcugaaccccuacaugcccaccgugaucgagcaccucgagcgccugcagcggaagcacggcgggaugcugguccgcaacccccucucccggaacagcacccacgagauguacuggaucuccaacggcaccgggaacaucguggcgagcgugaacauggucucccgccugcugcucaaccgguucacgaugacccaccgccggccgaccaucgagaaggacguggaccugggcgccggcacccgccacgugaacgccgagcccgagacgcccaacauggacgucaucggggagcggaucaagcgcaucaaggaggagcacaacagcaccuggcacuacgacgacgagaacccguacaagaccugggccuaccacggcuccuacgaggugaaggccaccgggagcgcguccagcaugaucaacggcguggucaagcugcucacgaagcccugggacgugguccccauggugacccagauggccaugaccgacaccacgcccuucgggcagcagcggguguucaaggagaaggucgacacccgcaccccgcggagcaugcccggcacccgccgggugaugggcaucacggccgaguggcuguggcgcacccuggggcggaacaagaagccccgccucugcacccgcgaggaguucaccaagaaggugcggacgaacgccgcgaugggcgccgucuucaccgaggagaaccagugggacuccgccaaggccgccguggaggacgaggacuucuggaagcugguggaccgcgagcgggagcugcacaagcucgggaagugcggcagcugcgucuacaacaugauggggaagcgcgagaagaagcugggcgaguucggcaaggcgaaggggucccgggccaucugguacauguggcugggcgcccgcuaccucgaguucgaggcccugggguuccugaacgaggaccacugguucagccgggagaacuccuacagcggcguggagggggagggccuccacaagcugggcuacauccugcgcgacaucuccaagauccccgggggcgccauguacgcggacgacaccgccgggugggacacccggaucacggaggacgaccuccacaacgaggagaagaucacccagcagauggacccggagcaccgccagcuggccaacgccaucuucaagcugaccuaccagaacaagguggucaaggugcagcggcccacccccaccggcacggugauggacaucaucagccgcaaggaccagcggggcuccgggcaggucggcaccuacgggcucaacaccuucaccaacauggaggcccagcugauccgccagauggagggcgagggggugcugagcaaggcggaccucgagaacccccaccucccggagaagaagaucacgcaguggcuggagaccaagggcguggagcggcucaagcgcauggccaucuccggcgacgacugcgucgugaagcccaucgacgaccgguucgccaacgcccugcuggcccucaacgacauggggaaggugcgcaaggacaucccccaguggcagcccagcaagggcuggcacgacuggcagcaggucccguucugcucccaccacuuccacgagcugaucaugaaggacgggcggaagcugguggugcccugccgcccccaggacgagcucaucggccgggcgcgcaucagccagggggccggcuggucccugcgcgagaccgccugccugggcaaggccuacgcgcagauguggagccucauguacuuccaccggcgcgaccugcggcuggccuccaacgccaucugcagcgccguccccgugcacugggugccgaccucccgcacgaccuggagcauccacgcccaccaccaguggaugaccaccgaggacaugcucacggucuggaaccggguguggaucgaggacaaccccuggauggaggacaagacccccgugaccaccugggaggacguccccuaccuggggaagcgcgaggaccaguggugcggcagccugaucgggcucacgucccgggcgaccugggcccagaacaucccgaccgccauccagcagguccgcagccugaucggcaacgaggaguuccuggacuacaugcccuccaugaagcgguuccgcaaggaggaggagagcgagggggccaucugguga

SEQ ID NO: 10085 - RNA, 9873 nt, Artificial Sequence
  derived and/or modified CDS sequence (opt1) from DENV-3__KJ189272__SS-prME
accagccucugccucaugaugauccugcccgccgcccuggcguuccaccucaccagccgggacggggagccgcggaugaucguggggaagaacgagcgcggcaagagccugcuguucaagaccgccagcgggaucaacaugugcacccucaucgccauggaccugggcgagaugugcgacgacaccgugaccuacaagugccccuacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugagcaucgaggccgagccgcccuucggggaguccaacaucgucaucggcaucggggacaacgcgcugaagaucaacugguacaagaagggcagcuccaucgggaagauguucgaggccaccgcccggggcgcccgccggauggccauccugggcgacacggcgugggacuucgggagcgugggcggggugcucaacucccugggcaagaugguccaccagaucuucgggagcgccuacaccgcccuguucuccggcgugagcugggugaugaagaucggcaucgggguccuccugaccuggaucggccugaacuccaagaacaccagcauguccuucagcugcaucgccaucgggaucaucacgcucuaccugggcgccguggugcaggcggacauggggugcgucaucaacuggaagggcaaggagcugaagugcggcuccgggaucuucgugaccaacgaggugcacaccuggaccgagcaguacaaguuccaggccgacagccccaagcgccucgccacggccaucgccggcgcgugggagaacggggucugcggcauccgcuccaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacagcuggaagaccugggggaaggccaagaucgugaccgccgagacgcagaacuccagcuucaucaucgacggccccaacacccccgagugccccuccgcgagccgggccuggaacgucugggagguggaggacuacggguucggcguguucaccaccaacaucuggcuccgccugcgggaggucuacacccagcugugcgaccaccgccucaugagcgccgccgugaaggacgagcgggccgugcacgcggacaugggcuacuggaucgagucccagaagaacgggagcuggaagcuggagaaggccucccugaucgaggucaagacgugcaccuggcccaagucccacacccucugguccaacggcgugcuggagagcgacaugaucauccccaagucccuggccgggcccaucagccagcacaaccaccgcccgggcuaccacacccagacggccgggcccuggcaccucggcaagcuggagcuggacuucaacuacugcgagggcaccaccguggucaucaccgagaacugcgggacgcggggccccucccuccgcaccaccaccgugagcgggaagcugauccacgaguggugcugccgguccugcacgcugcccccgcuccgcuacaugggcgaggacgggugcugguacggcauggagauccggcccaucagcgagaaggaggagaacauggugaagucccuggucagcgccggcuccgggaagguggacaacuucaccaugggcgugcugugccucgcgauccuguucgaggaggucaugcgcgggaaguucggcaagaagcacaugaucgccgggguguucuucaccuucgugcugcuccugagcggccagaucaccuggcgggacauggcccacacgcugaucaugaucggcuccaacgccagcgaccgcauggggaugggcgucaccuaccucgcccugaucgcgaccuucaagauccagcccuuccuggcccucggguucuuccugcggaagcugaccagccgcgagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucucccugaccugcagcaacaccaucuucacccugacgguggccuggcggaccgcgacccugauccucgccggggucucccugcugccggugugccagagcuccagcaugcgcaagaccgacuggcuccccauggccgucgccgccaugggcgugccgccccucccgcuguucaucuucucccucaaggacacgcugaagcgccggagcuggccccugaacgagggggugauggcggucggccucguguccauccuggccagcucccugcuccgcaacgacgugcccauggccggcccccuggucgccgggggccugcucaucgccugcuacgugaucaccgggaccagcgcggaccugaccguggagaaggccgccgacaucacgugggaggaggaggccgagcagaccggcgucucccacaaccugaugaucaccguggacgacgacgggaccaugcggaucaaggacgacgagaccgagaacauccucacggugcugcugaagaccgcccuccugaucgucagcggcaucuucccguacuccauccccgcgacccugcucguguggcacaccuggcagaagcagacgcagcgcagcggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgccgugcucaccuacaacgggaagcggcuggagcccaacugggccagcgugaagaaggaccugaucuccuacggcgggggcuggcgccucagcacccaguggcagaagggggaggagguccaggugaucgcgguggagcccggcaagaaccccaagaacuuccagaccaugcccggcacguuccagaccaccaccggggagaucggcgccaucgcccuggacuucaagcccgggacgagcggcucccccaucaucaaccgggagggcaaggucguggggcuguacggcaacgggguggucaccaagaacggcggguacgugagcggcaucgcccagaccaacgccgagccggacggccccacccccgagcuggaggaggagauguucaagaagcgcaaccucacgaucauggaccugcaccccggguccggcaagacccggaaguaccugccggcgaucgugcgcgaggccaucaagcggcgccuccggacccugauccuggcccccacccgcgucguggccgccgagauggaggaggcgcucaaggggcugcccauccgguaccagacgaccgccaccaagagcgagcacaccggccgcgagaucguggaccugaugugccacgccacguucaccaugcggcuccugucccccguccgcgugccgaacuacaaccugaucaucauggacgaggcccacuucaccgaccccgccagcaucgcggcccggggguacaucuccacccgcgugggcaugggcgaggccgccgcgaucuucaugacggccacgccgcccgggaccgccgacgccuucccgcagagcaacgcccccauccaggacgaggagcgcgacauccccgagcgguccuggaacagcggcaacgaguggaucaccgacuucgcggggaagacggucugguucgugcccuccaucaaggccggcaacgacaucgccaacugccuccgcaagaacgggaagaaggugauccagcugagccggaagaccuucgacaccgaguaccagaagaccaagcugaacgacugggacuucgucgugacgaccgacaucuccgagaugggcgccaacuucaaggccgaccgcgugaucgacccgcggcgcugccucaagcccgucauccugaccgacggccccgagcgggugauccuggcggggcccaugccggugaccgccgccagcgccgcccagcgccggggccgcgucgggcggaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgcgagaaguccgccgcgaucgacggcgaguaccggcugaagggcgagagccgcaagaccuucguggagcugaugcggcgcggggaccuccccguguggcuggcccacaaggucgccuccgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacagcgacccgcuggcccucaaggaguucaaggacuucgcggccggccggaaguccaucgcccuggaccuggucaccgagaucgggcgcgugcccagccaccucgcccaccggacccgcaacgcccuggacaaccuggugaugcuccacacgagcgagcacggcgggcgggcguaccgccacgccgucgaggagcugcccgagaccauggagacccugcuccugcugggccucaugauccugcugaccgggggcgccaugcuguuccugaucuccggcaaggggaucggcaagacgagcaucgggcugaucugcgugaucgccuccagcggcaugcucuggauggccgagaucccgcugcaguggaucgcguccgccaucgugcuggaguucuucaugaugguccuccugauccccgagcccgagaagcagcggacgccccaggacaaccagcuggccuacguggugaucgggauccucacccuggccgccaucaucgcggccaacgagaugggccugcucgagaccacgaagcgcgaccugggcaugagcaaggagccgggggucgugucccccaccagcuaccuggacguggaccuccaccccgccuccgccuggacccuguacgcggucgccaccacggugaucacccccaugcugcggcacaccaucgagaacagcaccgccaacgugucccucgccgccaucgcgaaccaggccgucgugcugaugggccuggacaagggguggccgaucagcaagauggaccucggcgugccccugcuggcccucgggugcuacucccaggucaacccccugacgcugaccgccgccgugcuccugcugaucacccacuacgcgaucaucggccccggccuccaggccaaggccacccgcgaggcccagaagcggacggccgcggggaucaugaagaacccgaccguggacggcaucaugaccaucgaccuggaccccgucaucuacgacagcaaguucgagaagcagcugggccaggugaugcuccuggugcugugcgccguccagcuccugcugaugcgcaccuccugggcccucugcgaggcccugacgcuggcgaccggccccaucaccacccucugggagggcagccccgggaaguucuggaacacgaccaucgccguguccauggccaacaucuuccggggcagcuaccuggccggggccggccuggcguucuccaucaugaaguccguggggaccggcaagcgcggcaccgggagccagggcgagacccucggggagaaguggaagaagaagcugaaccagcugucccggaaggaguucgaccucuacaagaaguccggcaucacggaggucgaccgcaccgaggccaaggaggggcugaagcggggcgagaucacccaccacgccgugucccgcggcagcgccaagcugcagugguucguggagcggaacauggucaucccggaggggcgcgugaucgaccucggcugcgggcggggcgggugguccuacuacugcgccggccugaagaaggugaccgagguccgcggcuacacgaagggcgggcccgggcacgaggagcccgugcccaugagcaccuacggcuggaacaucgugaagcugauguccgggaaggacgucuucuaccucccgcccgagaagugcgacacccugcugugcgacaucggcgagagcucccccagccccaccguggaggagucccgcacgauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugagccggaacuccacccacgagauguacuggaucagcaacggcaccgggaacaucguggcguccgugaacauggucagccgccuccugcugaaccgguucacgaugacccaccgccggccgaccaucgagaaggacguggaccucggcgccggcacccgccacgugaacgccgagcccgagacgcccaacauggacgucaucggggagcggaucaagcgcaucaaggaggagcacaacuccaccuggcacuacgacgacgagaacccguacaagaccugggccuaccacggcagcuacgaggugaaggccaccggguccgcgagcagcaugaucaacggcguggucaagcugcugacgaagcccugggacgugguccccauggugacccagauggccaugaccgacaccacgcccuucgggcagcagcggguguucaaggagaaggucgacacccgcaccccgcgguccaugcccggcacccgccgggugaugggcaucacggccgaguggcucuggcgcacccuggggcggaacaagaagccccgccugugcacccgcgaggaguucaccaagaaggugcggacgaacgccgcgaugggcgccgucuucaccgaggagaaccagugggacagcgccaaggccgccguggaggacgaggacuucuggaagcucguggaccgcgagcgggagcugcacaagcuggggaagugcggcuccugcgucuacaacaugauggggaagcgcgagaagaagcucggcgaguucggcaaggcgaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgcggacgacaccgccgggugggacacccggaucacggaggacgaccugcacaacgaggagaagaucacccagcagauggacccggagcaccgccagcucgccaacgccaucuucaagcugaccuaccagaacaagguggucaaggugcagcggcccacccccaccggcacggugauggacaucaucucccgcaaggaccagcggggcagcgggcaggucggcaccuacgggcugaacaccuucaccaacauggaggcccagcucauccgccagauggagggcgagggggugcuguccaaggcggaccuggagaacccccaccucccggagaagaagaucacgcaguggcuggagaccaagggcguggagcggcugaagcgcauggccaucagcggcgacgacugcgucgugaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcugguggugcccugccgcccccaggacgagcugaucggccgggcgcgcaucucccagggggccggcuggagccuccgcgagaccgccugccugggcaaggccuacgcgcagauguggucccugauguacuuccaccggcgcgaccuccggcuggccagcaacgccaucugcuccgccguccccgugcacugggugccgaccagccgcacgaccuggagcauccacgcccaccaccaguggaugaccaccgaggacaugcugacggucuggaaccggguguggaucgaggacaaccccuggauggaggacaagacccccgugaccaccugggaggacguccccuaccucgggaagcgcgaggaccaguggugcggcucccugaucgggcugacgagccgggcgaccugggcccagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10086 - RNA, 9873 nt, Artificial Sequence
  derived and/or modified CDS sequence (opt1) from DENV-3__KJ189273__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggugacccugcccgaguacggcacccuggggcucgagugcuccccgcgcacgggccuggacuucaacgagaugauccugcucaccaugaagaacaaggcguggauggugcaccggcagugguucuucgaccugccccugcccuggaccagcggcgccaccacggagacccccaccuggaaccgcaaggagcuccuggucaccuucaagaacgcccacgccaagaagcaggagguggugguccuggggucccaggagggcgccaugcacacggcgcucaccggggccaccgagauccagaacagcggcgggaccuccaucuucgccggccaccugaagugccggcugaagauggacaagcucgagcugaagggcaugagcuacgccaugugcacgaacaccuucgugcugaagaaggagguguccgagacccagcacgggaccauccucaucaaggucgaguacaagggcgaggacgccccgugcaagauccccuucagcacggaggacgggcacggcaaggcgcacaacggccgccugaucaccgccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacacggccugggacuucggguccgugggcgggguccucaacagccugggcaagauggugcaccagaucuucggguccgcguacaccgcccuguucagcggcguguccugggucaugaagaucggcaucggggugcuccugaccuggaucggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcuccgccugcgggagguguacacccagcugugcgaccaccgccucaugagcgccgccgugaaggacgagcgggccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccgucgugaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccugguguccgccggcagcgggaagguggacaacuucaccaugggcguccugugccucgccauccuguucgaggaggugaugcgcgggaaguucggcaagaagcacaugaucgcggggguguucuucaccuucguccugcuccuguccggccagaucaccuggcgggacauggcccacacgcugaucaugaucggcagcaacgccuccgaccgcauggggaugggcgugaccuaccucgcccugaucgccaccuucaagauccagcccuuccuggcgcucggguucuuccugcggaagcugaccagccgcgagaaccuccugcugggcgugggccucgccauggccacgacccugcagcugcccgaggacaucgagcagauggccaacgggaucgcgcucggccugauggcccugaagcucaucacccaguucgagaucuaccagcuguggaccgcccugaucagccucacgugcuccaacaccaucuucacccugaccgucgccuggcggacggccacccugauccucgcgggggugagccugcugccggucugccaguccagcuccaugcgcaagaccgacuggcuccccauggccguggccgccaugggcgugccgccccucccgcuguucaucuucagccucaaggacacccugaagcgccgguccuggccccugaacgagggggucauggccgugggccucgugagcauccuggcguccagccugcuccgcaacgacguccccauggccggcccccugguggccgggggccugcucaucgccugcuacgugaucacggggaccuccgccgaccugaccgucgagaaggcggccgacaucaccugggaggaggaggccgagcagacgggcgugagccacaaccugaugaucaccguggacgacgacgggaccaugcggaucaaggacgacgagaccgagaacauccucaccguccugcugaagacggcccuccugaucguguccggcaucuucccguacagcauccccgccacccugcucguguggcacaccuggcagaagcagacccagcgcuccggcguccugugggacgugcccagcccgcccgagacgcagaaggcggagcuggaggaggggguguaccggaucaagcagcagggcaucuucgggaagacccaggucggcgugggggugcagaaggagggcgucuuccacaccauguggcacgugacccgcggcgccgugcucacguacaacgggaagcggcuggagcccaacugggccuccgucaagaaggaccugaucagcuacggcgggggcuggcgccucuccacccaguggcagaagggggaggagguccaggugaucgccgucgagcccggcaagaaccccaagaacuuccagaccaugcccggcaccuuccagacgaccaccggggagaucggcgcgaucgcccuggacuucaagcccgggaccagcggcagccccaucaucaaccgggagggcaaggugguggggcuguacggcaacggggucgugacgaagaacggcggguacguguccggcaucgcccagaccaacgccgagccggacggccccacccccgagcuggaggaggagauguucaagaagcgcaaccucaccaucauggaccugcaccccgggagcggcaagacgcggaaguaccugccggccaucguccgcgaggcgaucaagcggcgccuccggacccugauccuggcccccacccgcgugguggccgccgagauggaggaggcccucaaggggcugcccauccgguaccagaccacggcgaccaaguccgagcacaccggccgcgagaucgucgaccugaugugccacgccaccuucacgaugcggcuccugagccccgugcgcgugccgaacuacaaccugaucaucauggacgaggcccacuucaccgaccccgccuccaucgccgcgcggggguacaucagcacccgcgucggcaugggcgaggccgccgccaucuucaugaccgcgacgccgcccgggaccgccgacgccuucccgcaguccaacgcccccauccaggacgaggagcgcgacauccccgagcggagcuggaacuccggcaacgaguggaucaccgacuucgccgggaagaccgugugguucgugcccagcaucaaggcgggcaacgacaucgccaacugccuccgcaagaacgggaagaaggucauccagcugucccggaagacguucgacaccgaguaccagaagaccaagcugaacgacugggacuucguggugaccacggacaucagcgagaugggcgccaacuucaaggccgaccgcgucaucgacccgcggcgcugccucaagcccgugauccugaccgacggccccgagcgggugauccuggccgggcccaugccggucaccgcggccuccgccgcccagcgccggggccgcguggggcggaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgcgagaaguccgccgccaucgacggcgaguaccggcugaagggcgagucccgcaagaccuucguggagcugaugcggcgcggggaccuccccgucuggcuggcgcacaagguggccagcgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccgcacguacuccgacccgcuggcccucaaggaguucaaggacuucgccgcgggccgcaagagcaucgcccuggaccuggugaccgagaucgggcgcgugcccucccaccucgcccaccggacccgcaacgcccuggacaaccuggucaugcuccacaccagcgagcacggcgggcgggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcggacgccccaggacaaccagcuggccuacguggucaucgggauccucacccuggccgccaucaucgccgcgaacgagaugggccugcucgagaccaccaagcgcgaccugggcauguccaaggagccggggguggugagccccacguccuaccuggacgucgaccuccaccccgccagcgccuggacccuguacgccguggcgaccaccgugaucacgcccaugcugcggcacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugacggccgccgugcuccugcugaucacccacuacgccaucaucggccccggccuccaggcgaaggccacccgcgaggcccagaagcggaccgccgccgggaucaugaagaacccgacggucgacggcaucaugaccaucgaccuggaccccgugaucuacgacuccaaguucgagaagcagcugggccaggugaugcuccugguccugugcgcggugcagcuccugcugaugcgcaccagcugggcccucugcgaggcccugacccuggccacgggccccaucaccacccucugggagggcucccccgggaaguucuggaacaccacgaucgcggugagcauggccaacaucuuccggggcuccuaccuggccggggccggccuggccuucagcaucaugaaguccgucgggaccggcaagcgcggcaccgggagccagggcgagacccucggggagaaguggaagaagaagcugaaccagcugagccggaaggaguucgaccucuacaagaaguccggcaucaccgagguggaccgcacggaggcgaaggaggggcugaagcggggcgagaucacccaccacgccgugagccgcggcuccgccaagcugcagugguucgucgagcggaacauggugaucccggaggggcgcgugaucgaccucggcugcgggcggggcggguggagcuacuacugcgccggccugaagaaggucaccgaggugcgcggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccgcaccauccggguccugaagaugguggagccguggcucaagaacaaccaguucugcaucaaggugcugaaccccuacaugcccacggucaucgagcaccuggagcgccuccagcggaagcacggcgggaugcuggugcgcaacccccugucccggaacagcacccacgagauguacuggaucuccaacggcaccgggaacaucguggccagcgucaacauggugucccgccuccugcugaaccgguucaccaugacgcaccgccggccgaccaucgagaaggacguggaccucggcgcgggcacccgccacgucaacgccgagcccgagacccccaacauggacgugaucggggagcggaucaagcgcaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgucgugcccauggugacgcagauggcgaugaccgacaccacccccuucgggcagcagcgggucuucaaggagaagguggacacgcgcaccccgcggagcaugcccggcacccgccgggugaugggcaucaccgccgaguggcucuggcgcacgcuggggcggaacaagaagccccgccugugcacccgcgaggaguucaccaagaagguccggaccaacgccgccaugggcgcgguguucacggaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaccggcaccgucauggacaucaucagccgcaaggaccagcggggcuccggccaggugggcacguacgggcugaacaccuucaccaacauggaggcccagcucauccgccagauggagggcgagggggugcugagcaaggccgaccuggagaacccccaccucccggagaagaagaucacccaguggcuggagacgaagggcgucgagcggcugaagcgcauggcgaucuccggcgacgacugcguggugaagcccaucgacgaccgguucgccaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggcgggcuggucccuccgcgagaccgccugccugggcaaggccuacgcccagauguggagccugauguacuuccaccggcgcgaccuccggcuggcguccaacgccaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggaggacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10087 - RNA, 9873 nt, Artificial Sequence
  derived and/or modified CDS sequence (opt1) from DENV-3__KJ189274__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggccgccggacgcugacgccccagccgauggagcugaaguacuccuggaagaccugggggaaggccaagaucgugaccgccgagacgcagaacagcuccuucaucaucgacggccccaacacccccgagugccccagcgcgucccgcgccuggaacgucugggagguggaggacuacggguucggcguguucaccaccaacaucuggcuccggcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccggccgggcuaccacacccagacggccgggcccuggcaccucggcaagcuggagcuggacuucaacuacugcgagggcaccaccguggucaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccuggucuccgccggcagcgggaagguggacaacuucaccaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacgcugaucaugaucggcagcaacgccuccgaccggauggggaugggcgucaccuaccucgcccugaucgcgaccuucaagauccagcccuuccuggcccucggguucuuccugcgcaagcugaccagccgggagaaccuccugcugggcgugggccucgccauggccacgacccugcagcugcccgaggacaucgagcagauggcgaacgggaucgcccucggccugauggcccugaagcucaucacccaguucgagaucuaccagcuguggaccgcccugaucagccucacgugcuccaacaccaucuucacccugaccguggccuggcgcacggcgacccugauccucgccggggucagccugcugccggugugccaguccagcuccaugcgcaagaccgacuggcuccccauggccgucgccgccaugggcgugccgccccucccgcuguucaucuucagccucaaggacacccugaagcggcgcuccuggccccugaacgagggggugauggcggucggccucgugagcauccuggccuccagccugcuccggaacgacgugcccauggccggcccccuggucgccgggggccugcucaucgccugcuacgugaucacggggaccuccgcggaccugaccguggagaaggccgccgacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcaucuucccguacagcauccccgcgacccugcucguguggcacaccuggcagaagcagacccagcgguccggcgugcugugggacguccccagcccgcccgagacgcagaaggccgagcuggaggaggggguguaccgcaucaagcagcagggcaucuucgggaagacccaggugggcgucggggugcagaaggagggcguguuccacaccauguggcacgucacccggggcgccgugcucacguacaacgggaagcgccuggagcccaacugggccuccgugaagaaggaccugaucagcuacggcgggggcuggcggcucuccacccaguggcagaagggggaggagguccaggugaucgcgguggagcccggcaagaaccccaagaacuuccagaccaugcccggcaccuuccagacgaccaccggggagaucggcgccaucgcccuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggcgaucgugcgggaggccaucaagcgccggcuccgcacccugauccuggcccccacccgggucguggccgccgagauggaggaggcgcucaaggggcugcccauccgcuaccagaccacggccaccaaguccgagcacaccggccgggagaucguggaccugaugugccacgccaccuucacgaugcgccuccugagccccguccgggugccgaacuacaaccugaucaucauggacgaggcccacuucaccgaccccgccuccaucgcggcccgcggguacaucagcacccgcgugggcaugggcgaggccgccgcgaucuucaugaccgccacgccgcccgggaccgccgacgccuucccgcaguccaacgcccccauccaggacgaggagcgggacauccccgagcgcagcuggaacuccggcaacgaguggaucaccgacuucgcggggaagaccgucugguucgugcccagcaucaaggccggcaacgacaucgccaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggcggggcccaugccggugaccgccgccuccgccgcccagcggcgcggccgggucgggcgcaacccccagaaggagaacgaccaguacaucuucaccggccagccccucaacaacgacgaggaccacgcgcacuggaccgaggccaagaugcugcuggacaacaucaacacgcccgaggggaucaucccggcccucuucgagcccgagcgggagaaguccgccgcgaucgacggcgaguaccgccugaagggcgagucccggaagaccuucguggagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgcuggcuggacgcccggacguacuccgacccgcuggcccucaaggaguucaaggacuucgcggccggccgcaagagcaucgcccuggaccuggucaccgagaucgggcgggugcccucccaccucgcccaccgcacccggaacgcccuggacaaccuggugaugcuccacaccagcgagcacggcgggcgcgcguaccggcacgccgucgaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucgugcuggaguucuucaugaugguccuccugauccccgagcccgagaagcagcgcacgccccaggacaaccagcuggccuacguggugaucgggauccucacccuggccgccaucaucgcggccaacgagaugggccugcucgagaccaccaagcgggaccugggcauguccaaggagccgggggucgugagccccacguccuaccuggacguggaccuccaccccgccagcgccuggacccuguacgcggucgccaccaccgugaucacgcccaugcugcgccacaccaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacccugacggccgccgugcuccugcugaucacccacuacgcgaucaucggccccggccuccaggccaaggccacccgggaggcccagaagcgcaccgccgcggggaucaugaagaacccgacgguggacggcaucaugaccaucgaccuggaccccgucaucuacgacuccaaguucgagaagcagcugggccaggugaugcuccuggugcugugcgccguccagcuccugcugaugcggaccagcugggcccucugcgaggcccugacccuggcgacgggccccaucaccacccucugggagggcucccccgggaaguucuggaacaccacgaucgccgugagcauggccaacaucuuccgcggcuccuaccuggccggggccggccuggcguucagcaucaugaaguccguggggaccggcaagcggggcaccgggagccagggcgagacccucggggagaaguggaagaagaagcugaaccagcugagccgcaaggaguucgaccucuacaagaaguccggcaucaccgaggucgaccggacggaggccaaggaggggcugaagcgcggcgagaucacccaccacgccgugagccggggcuccgccaagcugcagugguucguggagcgcaacauggucaucccggaggggcgggugaucgaccucggcugcgggcgcggcggguggagcuacuacugcgccggccugaagaaggugaccgagguccgcggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccggaccauccgcgugcugaagauggucgagccguggcucaagaacaaccaguucugcaucaaggugcugaaccccuacaugcccacggugaucgagcaccuggagcggcuccagcgcaagcacggcgggaugcugguccggaacccccugucccgcaacagcacccacgagauguacuggaucuccaacggcaccgggaacaucguggcgagcgugaacauggucucccggcuccugcugaaccgcuucaccaugacgcaccggcgcccgaccaucgagaaggacguggaccucggcgccggcacccggcacgugaacgccgagcccgagacccccaacauggacgucaucggggagcgcaucaagcggauccgcgaggagcacaacagcacguggcacuacgacgacgagaacccguacaagaccugggccuaccacggcuccuacgaggugaaggccaccgggagcgcguccagcaugaucaacggcguggucaagcugcugaccaagcccugggacgugguccccauggugacgcagauggccaugaccgacaccacccccuucgggcagcagcggguguucaaggagaaggucgacacgcgcaccccgcggagcaugcccggcacccgccgggugaugggcaucaccgccgaguggcucuggcgcacgcuggggcgcaacaagaagccccggcugugcacccgcgaggaguucaccaagaaggugcggaccaacgccgcgaugggcgccgucuucacggaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacaccgccgggugggacacccggaucaccgaggacgaccugcacaacgaggagaagaucacgcagcagauggacccggagcaccgccagcucgccaacgccaucuucaagcugaccuaccagaacaagguggucaaggugcagcggcccacccccaccggcaccgugauggacaucaucagccgcaaggaccagcggggcuccgggcaggucggcacguacgggcugaacaccuucaccaacauggaggcccagcucauccgccagauggagggcgagggggugcugagcaaggcggaccuggagaacccccaccucccggagaagaagaucacccaguggcuggagacgaagggcguggagcggcugaagcgcauggccaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgcgcgcggaucagccagggggccggcuggucccuccgcgagaccgccugccugggcaaggccuacgcgcagauguggagccugauguacuuccaccggcgcgaccuccggcuggccuccaacgccaucugcagcgccguccccgugcacugggugccgaccucccgcaccacguggagcauccacgcccaccaccaguggaugaccaccgaggacaugcugaccgucuggaaccggguguggaucgaggacaaccccuggauggaggacaagacgcccgugaccaccugggaggacguccccuaccucgggaagcgcgaggaccaguggugcggcagccugaucgggcugaccucccgggcgacgugggcccagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10088 - RNA, 9873 nt, Artificial Sequence
  derived and/or modified CDS sequence (opt1) from DENV-3__KJ189275__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggccgccggacgcugacgccccagccgauggagcugaaguacuccuggaagaccugggggaaggccaagaucgugaccgccgagacgcagaacagcuccuucaucaucgacggccccaacacccccgagugccccagcgcgucccgcgccuggaacgucugggagguggaggacuacggguucggcguguucaccaccaacaucuggcuccggcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccggccgggcuaccacacccagacggccgggcccuggcaccucggcaagcuggagcuggacuucaacuacugcgagggcaccaccguggucaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccuggucuccgccggcagcgggaagguggacaacuucaccaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacgcugaucaugaucggcagcaacgccuccgaccggauggggaugggcgucaccuaccucgcccugaucgcgaccuucaagauccagcccuuccuggcccucggguucuuccugcgcaagcugaccagccgggagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccaucuucacccugacgguggccuggcgcaccgcgacccugauccucgccggggucagccugcugccggugugccaguccagcuccaugcgcaagaccgacuggcuccccauggccgucgccgccaugggcgugccgccccucccgcuguucaucuucagccucaaggacacgcugaagcggcgcuccuggccccugaacgagggggugauggcggucggccucgugagcauccuggccuccagccugcuccggaacgacgugcccauggccggcccccuggucgccgggggccugcucaucgccugcuacgugaucaccgggaccuccgcggaccugaccguggagaaggccgccgacaucacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcaucuucccguacagcauccccgcgacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgccgugcucaccuacaacgggaagcgccuggagcccaacugggccuccgugaagaaggaccugaucagcuacggcgggggcuggcggcucuccacccaguggcagaagggggaggagguccaggugaucgcgguggagcccggcaagaaccccaagaacuuccagaccaugcccggcacguuccagaccaccaccggggagaucggcgccaucgcccuggacuucaagcccgggacgagcggcagccccaucaucaaccgcgagggcaaggucguggggcuguacggcaacgggguggucaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucgugcgggaggccaucaagcgccggcuccgcacccugauccuggcccccacccgggucguggccgccgagauggaggaggcgcucaaggggcugcccauccgcuaccagacgaccgccaccaaguccgagcacaccggccgggagaucguggaccugaugugccacgccacguucaccaugcgccuccugagccccguccgggugccgaacuacaaccugaucaucauggacgaggcccacuucaccgaccccgccuccaucgcggcccgcggguacaucagcacccgcgugggcaugggcgaggccgccgcgaucuucaugacggccacgccgcccgggaccgccgacgccuucccgcaguccaacgcccccauccaggacgaggagcgggacauccccgagcgcagcuggaacuccggcaacgaguggaucaccgacuucgcggggaagacggucugguucgugcccagcaucaaggccggcaacgacaucgccaacugccuccggaagaacgggaagaaggugauccagcugucccgcaagaccuucgacaccgaguaccagaagaccaagcugaacgacugggacuucgucgugacgaccgacaucagcgagaugggcgccaacuucaaggccgaccgggugaucgacccgcgccggugccucaagcccgucauccugaccgacggccccgagcgcgugauccuggcggggcccaugccggugaccgccgccuccgccgcccagcggcgcggccgggucgggcgcaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgggagaaguccgccgcgaucgacggcgaguaccgccugaagggcgagucccggaagaccuucguggagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggacgaaggagggcgagaagaagaagcuccgcccccgcuggcuggacgcccggaccuacuccgacccgcuggcccucaaggaguucaaggacuucgcggccggccgcaagagcaucgcccuggaccuggucaccgagaucgggcgggugcccucccaccucgcccaccgcacccggaacgcccuggacaaccuggugaugcuccacacgagcgagcacggcgggcgcgcguaccggcacgccgucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucgugcuggaguucuucaugaugguccuccugauccccgagcccgagaagcagcgcacgccccaggacaaccagcuggccuacguggugaucgggauccucacccuggccgccaucaucgcggccaacgagaugggccugcucgagaccacgaagcgggaccugggcauguccaaggagccgggggucgugagccccaccuccuaccuggacguggaccuccaccccgccagcgccuggacccuguacgcggucgccaccacggugaucacccccaugcugcgccacaccaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacgcugaccgccgccgugcuccugcugaucacccacuacgcgaucaucggccccggccuccaggccaaggccacccgggaggcccagaagcgcacggccgcggggaucaugaagaacccgaccguggacggcaucaugaccaucgaccuggaccccgucaucuacgacuccaaguucgagaagcagcugggccaggugaugcuccuggugcugugcgccguccagcuccugcugaugcggaccagcugggcccucugcgaggcccugacgcuggcgaccggccccaucaccacccucugggagggcucccccgggaaguucuggaacacgaccaucgccgugagcauggccaacaucuuccgcggcuccuaccuggccggggccggccuggcguucagcaucaugaaguccguggggaccggcaagcggggcaccgggagccagggcgagacccucggggagaaguggaagaagaagcugaaccagcugagccgcaaggaguucgaccucuacaagaaguccggcaucacggaggucgaccggaccgaggccaaggaggggcugaagcgcggcgagaucacccaccacgccgugagccggggcuccgccaagcugcagugguucguggagcgcaacauggucaucccggaggggcgggugaucgaccucggcugcgggcgcggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccggacgauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugucccgcaacagcacccacgagauguacuggaucuccaacggcaccgggaacaucguggcgagcgugaacauggucucccggcuccugcugaaccgcuucacgaugacccaccggcgcccgaccaucgagaaggacguggaccucggcgccggcacccggcacgugaacgccgagcccgagacgcccaacauggacgucaucggggagcgcaucaagcggauccgcgaggagcacaacagcaccuggcacuacgacgacgagaacccguacaagaccugggccuaccacggcuccuacgaggugaaggccaccgggagcgcguccagcaugaucaacggcguggucaagcugcugacgaagcccugggacgugguccccauggugacccagauggccaugaccgacaccacgcccuucgggcagcagcggguguucaaggagaaggucgacacccgcaccccgcggagcaugcccggcacccgccgggugaugggcaucacggccgaguggcucuggcgcacccuggggcgcaacaagaagccccggcugugcacccgcgaggaguucaccaagaaggugcggacgaacgccgcgaugggcgccgucuucaccgaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacaccgccgggugggacacccggaucacggaggacgaccugcacaacgaggagaagaucacccagcagauggacccggagcaccgccagcucgccaacgccaucuucaagcugaccuaccagaacaagguggucaaggugcagcggcccacccccaccggcacggugauggacaucaucagccgcaaggaccagcggggcuccgggcaggucggcaccuacgggcugaacaccuucaccaacauggaggcccagcucauccgccagauggagggcgagggggugcugagcaaggcggaccuggagaacccccaccucccggagaagaagaucacgcaguggcuggagaccaagggcguggagcggcugaagcgcauggccaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgcgcgcggaucagccagggggccggcuggucccuccgcgagaccgccugccugggcaaggccuacgcgcagauguggagccugauguacuuccaccggcgcgaccuccggcuggccuccaacgccaucugcagcgccguccccgugcacugggugccgaccucccgcacgaccuggagcauccacgcccaccaccaguggaugaccaccgaggacaugcugacggucuggaaccggguguggaucgaggacaaccccuggauggaggacaagacccccgugaccaccugggaggacguccccuaccucgggaagcgcgaggaccaguggugcggcagccugaucgggcugacgucccgggcgaccugggcccagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10089 - RNA, 9873 nt, Artificial Sequence
  derived and/or modified CDS sequence (opt1) from DENV-3__KJ189276__SS-prME
accagccugugccucaugaugauccugcccgccgcccuggcguuccaccucaccagccgggacggggagccgcggaugaucguggggaagaacgagcgcggcaagagccugcuguucaagacggccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcuccagugcuccccgcgcacgggccuggacuucaacgagaugauccugcucaccaugaagaacaaggccuggauggugcaccggcagugguucuucgaccugccccugcccuggaccagcggcgccaccuccgagacgcccaccuggaaccgcaaggagcuccuggugaccuucaagaacgcccacgccaagaagcaggaggucguggugcuggggagccaggagggcgcgaugcacaccgcccucacgggggccaccgagauccagaacuccggcgggaccagcaucuucgccggccaccugaagugccggcugaagauggacaagcucgagcugaagggcauguccuacgccaugugcaccaacacguucguccugaagaaggaggugagcgagacccagcacgggaccauccucaucaagguggaguacaagggcgaggacgcgccgugcaagauccccuucagcaccgaggacgggcacggcaaggcccacaacggccgccugaucacggccaaccccgucgugaccaagaaggaggagcccgugaacaucgaggccgagccgcccuucggggaguccaacaucgucaucggcaucggggacaacgcgcugaagaucaacugguacaagaagggcagcuccaucgggaagauguucgaggccaccgcccggggcgcccgccggauggccauccugggcgacaccgcgugggacuucgggagcgugggcggggugcucaacucccugggcaagaugguccaccagaucuucgggagcgccuacacggcccuguucuccggcgugagcugggugaugaagaucggcaucgggguccuccugaccuggaucggccugaacuccaagaacaccagcauguccuucagcugcaucgccaucgggaucaucacccucuaccugggcgccguggugcaggcggacauggggugcgucaucaacuggaagggcaaggagcugaagugcggcuccgggaucuucgugacgaacgaggugcacaccuggaccgagcaguacaaguuccaggccgacagccccaagcgccucgccaccgccaucgccggcgcgugggagaacggggucugcggcauccgcuccacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacagcuggaagaccugggggaaggccaagaucgugaccgccgagacccagaacuccagcuucaucaucgacggccccaacacgcccgagugccccuccgcgagccgggccuggaacgucugggagguggaggacuacggguucggcguguucaccaccaacaucuggcuccgccugcgggaggucuacacccagcugugcgaccaccgccucaugagcgccgccgugaaggacgagcgggccgugcacgcggacaugggcuacuggaucgagucccagaagaacgggagcuggaagcuggagaaggccucccugaucgaggucaagaccugcacguggcccaagucccacacccucugguccaacggcgugcuggagagcgacaugaucauccccaagucccuggccgggcccaucagccagcacaaccaccgcccgggcuaccacacccagaccgccgggcccuggcaccucggcaagcuggagcuggacuucaacuacugcgagggcacgaccguggucaucaccgagaacugcgggacccggggccccucccuccgcacgaccaccgugagcgggaagcugauccacgaguggugcugccgguccugcacccugcccccgcuccgcuacaugggcgaggacgggugcugguacggcauggagauccggcccaucagcgagaaggaggagaacauggugaagucccuggucagcgccggcuccgggaagguggacaacuucacgaugggcgugcugugccucgcgauccuguucgaggaggucaugcgcgggaaguucggcaagaagcacaugaucgccgggguguucuucaccuucgugcugcuccugagcggccagaucaccuggcgggacauggcccacacccugaucaugaucggcuccaacgccagcgaccgcauggggaugggcgucacguaccucgcccugaucgcgaccuucaagauccagcccuuccuggcccucggguucuuccugcggaagcugaccagccgcgagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucucccucacgugcagcaacaccaucuucacccugaccguggccuggcggacggcgacccugauccucgccggggucucccugcugccggugugccagagcuccagcaugcgcaagaccgacuggcuccccauggccgucgccgccaugggcgugccgccccucccgcuguucaucuucucccucaaggacacccugaagcgccggagcuggccccugaacgagggggugauggcggucggccucguguccauccuggccagcucccugcuccgcaacgacgugcccauggccggcccccuggucgccgggggccugcucaucgccugcuacgugaucacggggaccagcgcggaccugaccguggagaaggccgccgacaucaccugggaggaggaggccgagcagacgggcgucucccacaaccugaugaucaccguggacgacgacgggaccaugcggaucaaggacgacgagaccgagaacauccucaccgugcugcugaagacggcccuccugaucgucagcggcaucuucccguacuccauccccgcgacccugcucguguggcacaccuggcagaagcagacccagcgcagcggcgugcugugggacguccccagcccgcccgagacgcagaaggccgagcuggaggaggggguguaccggaucaagcagcagggcaucuucgggaagacccaggugggcgucggggugcagaaggagggcguguuccacaccauguggcacgucacccgcggcgccgugcucacguacaacgggaagcggcuggagcccaacugggccagcgugaagaaggaccugaucuccuacggcgggggcuggcgccucagcacccaguggcagaagggggaggagguccaggugaucgcgguggagcccggcaagaaccccaagaacuuccagaccaugcccggcaccuuccagacgaccaccggggagaucggcgccaucgcccuggacuucaagcccgggaccagcggcucccccaucaucaaccgggagggcaaggucguggggcuguacggcaacgggguggucacgaagaacggcggguacgugagcggcaucgcccagaccaacgccgagccggacggccccacccccgagcuggaggaggagauguucaagaagcgcaaccucaccaucauggaccugcaccccggguccggcaagacgcggaaguaccugccggcgaucgugcgcgaggccaucaagcggcgccuccggacccugauccuggcccccacccgcgucguggccgccgagauggaggaggcgcucaaggggcugcccauccgguaccagaccacggccaccaagagcgagcacaccggccgcgagaucguggaccugaugugccacgccaccuucacgaugcggcuccugucccccguccgcgugccgaacuacaaccugaucaucauggacgaggcccacuucaccgaccccgccagcaucgcggcccggggguacaucuccacccgcgugggcaugggcgaggccgccgcgaucuucaugaccgccacgccgcccgggaccgccgacgccuucccgcagagcaacgcccccauccaggacgaggagcgcgacauccccgagcgguccuggaacagcggcaacgaguggaucaccgacuucgcggggaagaccgucugguucgugcccuccaucaaggccggcaacgacaucgccaacugccuccgcaagaacgggaagaaggugauccagcugagccggaagacguucgacaccgaguaccagaagaccaagcugaacgacugggacuucgucgugaccacggacaucuccgagaugggcgccaacuucaaggccgaccgcgugaucgacccgcggcgcugccucaagcccgucauccugaccgacggccccgagcgggugauccuggcggggcccaugccggugaccgccgccagcgccgcccagcgccggggccgcgucgggcggaacccccagaaggagaacgaccaguacaucuucaccggccagccccucaacaacgacgaggaccacgcgcacuggaccgaggccaagaugcugcuggacaacaucaacacgcccgaggggaucaucccggcccucuucgagcccgagcgcgagaaguccgccgcgaucgacggcgaguaccggcugaagggcgagagccgcaagaccuucguggagcugaugcggcgcggggaccuccccguguggcuggcccacaaggucgccuccgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcacguacagcgacccgcuggcccucaaggaguucaaggacuucgcggccggccggaaguccaucgcccuggaccuggucaccgagaucgggcgcgugcccagccaccucgcccaccggacccgcaacgcccuggacaaccuggugaugcuccacaccagcgagcacggcgggcgggcguaccgccacgccgucgaggagcugcccgagacgauggagacccugcuccugcugggccucaugauccugcugaccgggggcgccaugcuguuccugaucuccggcaaggggaucggcaagaccagcaucgggcugaucugcgugaucgccuccagcggcaugcucuggauggccgagaucccgcugcaguggaucgcguccgccaucgugcuggaguucuucaugaugguccuccugauccccgagcccgagaagcagcggacgccccaggacaaccagcuggccuacguggugaucgggauccucacccuggccgccaucaucgcggccaacgagaugggccugcucgagaccaccaagcgcgaccugggcaugagcaaggagccgggggucgugucccccacgagcuaccuggacguggaccuccaccccgccuccgccuggacccuguacgcggucgccaccaccgugaucacgcccaugcugcggcacaccaucgagaacagcaccgccaacgugucccucgccgccaucgcgaaccaggccgucgugcugaugggccuggacaagggguggccgaucagcaagauggaccucggcgugccccugcuggcccucgggugcuacucccaggucaacccccugacccugacggccgccgugcuccugcugaucacccacuacgcgaucaucggccccggccuccaggccaaggccacccgcgaggcccagaagcggaccgccgcggggaucaugaagaacccgacgguggacggcaucaugaccaucgaccuggaccccgucaucuacgacagcaaguucgagaagcagcugggccaggugaugcuccuggugcugugcgccguccagcuccugcugaugcgcaccuccugggcccucugcgaggcccugacccuggcgacgggccccaucaccacccucugggagggcagccccgggaaguucuggaacaccacgaucgccguguccauggccaacaucuuccggggcagcuaccuggccggggccggccuggcguucuccaucaugaaguccguggggaccggcaagcgcggcaccgggagccagggcgagacccucggggagaaguggaagaagaagcugaaccagcugucccggaaggaguucgaccucuacaagaaguccggcaucaccgaggucgaccgcacggaggccaaggaggggcugaagcggggcgagaucacccaccacgccgugucccgcggcagcgccaagcugcagugguucguggagcggaacauggucaucccggaggggcgcgugaucgaccucggcugcgggcggggcgggugguccuacuacugcgccggccugaagaaggugaccgagguccgcggcuacaccaagggcgggcccgggcacgaggagcccgugcccaugagcacguacggcuggaacaucgugaagcugauguccgggaaggacgucuucuaccucccgcccgagaagugcgacacccugcugugcgacaucggcgagagcucccccagccccaccguggaggagucccgcaccauccgggugcugaagauggucgagccguggcucaagaacaaccaguucugcaucaaggugcugaaccccuacaugcccacggugaucgagcaccuggagcgccuccagcggaagcacggcgggaugcugguccgcaacccccugagccggaacuccacccacgagauguacuggaucagcaacggcaccgggaacaucguggcguccgugaacauggucagccgccuccugcugaaccgguucaccaugacgcaccgccggccgaccaucgagaaggacguggaccucggcgccggcacccgccacgugaacgccgagcccgagacccccaacauggacgucaucggggagcggaucaagcgcaucaaggaggagcacaacuccacguggcacuacgacgacgagaacccguacaagaccugggccuaccacggcagcuacgaggugaaggccaccggguccgcgagcagcaugaucaacggcguggucaagcugcugaccaagcccugggacgugguccccauggugacgcagauggccaugaccgacaccacccccuucgggcagcagcggguguucaaggagaaggucgacacgcgcaccccgcgguccaugcccggcacccgccgggugaugggcaucaccgccgaguggcucuggcgcacgcuggggcggaacaagaagccccgccugugcacccgcgaggaguucaccaagaaggugcggaccaacgccgcgaugggcgccgucuucacggaggagaaccaguggaacagcgccaaggccgccguggaggacgaggacuucuggaagcucguggaccgcgagcgggagcugcacaagcuggggaagugcggcuccugcgucuacaacaugauggggaagcgcgagaagaagcucggcgaguucggcaaggcgaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgcggacgacaccgccgggugggacacccggaucaccgaggacgaccugcacaacgaggagaagaucacgcagcagauggacccggagcaccgccggcucgccaacgccaucuucaagcugaccuaccagaacaagguggucaaggugcagcgccccacccccaccggcaccgugauggacaucaucucccggaaggaccagcgcggcagcgggcaggucggcacguacgggcugaacaccuucaccaacauggaggcccagcucauccggcagauggagggcgagggggugcuguccaaggcggaccuggagaacccccaccucccggagaagaagaucacccaguggcuggagacgaagggcguggagcgccugaagcggauggccaucagcggcgacgacugcgucgugaagcccaucgacgaccgcuucgccaacgcccuccuggcccugaacgacauggggaaggugcggaaggacaucccccaguggcagcccuccaagggcuggcacgacuggcagcaggucccguucugcagccaccacuuccacgagcucaucaugaaggacgggcgcaagcugguggugcccugccggccccaggacgagcugaucggccgcgcgcgcaucucccagggggccggcuggagccuccgggagaccgccugccugggcaaggccuacgcgcagauguggucccugauguacuuccaccgccgggaccuccgccuggccagcaacgccaucugcuccgccguccccgugcacugggugccgaccagccggaccacguggagcauccacgcccaccaccaguggaugaccaccgaggacaugcugaccgucuggaaccgcguguggaucgaggacaaccccuggauggaggacaagacgcccgugaccaccugggaggacguccccuaccucgggaagcgggaggaccaguggugcggcucccugaucgggcugaccagccgcgcgacgugggcccagaacaucccgaccgccauccagcagguccggucccucaucggcaacgaggaguuccuggacuacaugcccagcaugaagcgcuuccggaaggaggaggaguccgagggggccaucugguga

SEQ ID NO: 10090 - RNA, 9873 nt, Artificial Sequence
  derived and/or modified CDS sequence (opt1) from DENV-3__KJ189277__SS-prME
accagccugugccucaugaugauccugcccgccgcccuggcguuccaccucaccagccgcgacggggagccgcggaugaucguggggaagaacgagcgcggcaagagccugcuguucaagacggccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcuccagugcuccccgcgcacgggccuggacuucaacgagaugauccugcucaccaugaagaacaaggccuggauggugcaccggcagugguucuucgaccugccccugcccuggaccagcggcgccaccuccgagacgcccaccuggaaccgcaaggagcuccuggugaccuucaagaacgcccacgccaagaagcaggaggucguggugcuggggagccaggagggcgcgaugcacaccgcccucacgggggccaccgagauccagaacuccggcgggaccagcaucuucgccggccaccugaagugccggcugaagauggacaagcucgagcugaagggcauguccuacgccaugugcaccaacacguucguccugaagaaggaggugagcgagacccagcacgggaccauccucaucaagguggaguacaagggcgaggacgcgccgugcaagauccccuucagcaccgaggacgggcacggcaaggcccacaacggccgccugaucacggccaaccccgucgugaccaagaaggaggagcccgugaacaucgaggccgagccgcccuucggggaguccaacaucgucaucggcaucggggacaacgcgcugaagaucaacugguacaagaagggcagcuccaucgggaagauguucgaggccaccgcccggggcgcccgccggauggccauccugggcgacaccgcgugggacuucgggagcgugggcggggugcucaacucccugggcaagaugguccaccagaucuucgggagcgccuacacggcccuguucuccggcgugagcugggugaugaagaucggcaucgggguccuccugaccuggaucggccugaacuccaagaacaccagcauguccuucagcugcaucgccaucgggaucaucacccucuaccugggcgccguggugcaggcggacauggggugcgucaucaacuggaagggcaaggagcugaagugcggcuccgggaucuucgugacgaacgaggugcacaccuggaccgagcaguacaaguuccaggccgacagccccaagcgccucgccaccgccaucgccggcgcgugggagaacggggucugcggcauccgcuccacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacagcuggaagaccugggggaaggccaagaucgugaccgccgagacccagaacuccagcuucaucaucgacggccccaacacgcccgagugccccuccgcgagccgggccuggaacgucugggagguggaggacuacggguucggcguguucaccaccaacaucuggcuccgccugcgggaggccuacacccagcugugcgaccaccgccucaugagcgccgccgucaaggacgagcgggcggugcacgccgacaugggcuacuggaucgagucccagaagaacgggagcuggaagcuggagaaggccucccugaucgaggugaagaccugcacguggcccaagucccacacccucugguccaacggcguccuggagagcgacaugaucauccccaagucccuggccgggcccaucagccagcacaaccaccgcccgggcuaccacacccagaccgccgggcccuggcaccucggcaagcuggagcuggacuucaacuacugcgagggcacgaccguggugaucaccgagaacugcgggacccggggccccucccuccgcacgaccaccgucagcgggaagcugauccacgaguggugcugccgguccugcacccugcccccgcuccgcuacaugggcgaggacgggugcugguacggcauggagauccggcccaucagcgagaaggaggagaacauggugaagucccuggugagcgcgggcuccgggaaggucgacaacuucacgaugggcgugcugugccucgccauccuguucgaggaggugaugcgcgggaaguucggcaagaagcacaugaucgccggggucuucuucaccuucgugcugcuccugagcggccagaucaccuggcgggacauggcccacacccugaucaugaucggcuccaacgccagcgaccgcauggggaugggcgugacguaccucgcgcugaucgccaccuucaagauccagcccuuccuggcccucggguucuuccugcggaagcugaccagccgcgagaaccuccugcugggcgucggccucgccauggcgaccacgcugcagcugcccgaggacaucgagcagauggccaacgggaucgcccucggccugauggcccugaagcucaucacccaguucgagaccuaccagcuguggaccgcccugaucucccucacgugcagcaacaccaucuucacccugaccguggcguggcggacggccacccugauccucgccggggugucccugcugccggucugccagagcuccagcaugcgcaagaccgacuggcuccccauggccguggccgcgaugggcgugccgccccucccgcuguucaucuucucccucaaggacacccugaagcgccggagcuggccccugaacgagggggugauggccgugggccucgucuccauccuggccagcucccugcuccgcaacgacgugcccauggccggcccccugguggccgggggccugcucaucgcgugcuacgucaucacggggaccagcgccgaccugaccguggagaaggccgccgacaucaccugggaggaggaggccgagcagacgggcgugucccacaaccugaugaucaccgucgacgacgacgggaccaugcggaucaaggacgacgagaccgagaacauccucaccgugcugcugaagacggcgcuccugaucgugagcggcaucuucccguacuccauccccgccacccugcucgucuggcacaccuggcagaagcagacccagcgcagcggcgugcugugggacgugcccagcccgcccgagacgcagaaggccgagcuggaggagggggucuaccggaucaagcagcagggcaucuucgggaagacccaggugggcguggggguccagaaggagggcguguuccacaccauguggcacgugacccgcggcgccguccucacguacaacgggaagcggcuggagcccaacugggcgagcgugaagaaggaccugaucuccuacggcgggggcuggcgccucagcacccaguggcagaagggggaggaggugcaggucaucgccguggagcccggcaagaaccccaagaacuuccagaccaugcccggcaccuuccagacgaccaccggggagaucggcgccaucgcccuggacuucaagcccgggaccagcggcucccccaucaucaaccgggagggcaagguggucgggcuguacggcaacgggguggugacgaagaacggcggguacgucagcggcaucgcccagaccaacgcggagccggacggccccacccccgagcuggaggaggagauguucaagaagcgcaaccucaccaucauggaccugcaccccggguccggcaagacgcggaaguaccugccggccaucgugcgcgaggccaucaagcggcgccuccggacccugauccuggcccccacccgcguggucgccgcggagauggaggaggcccucaaggggcugcccauccgguaccagaccacggccaccaagagcgagcacaccggccgcgagaucguggaccugaugugccacgccaccuucacgaugcggcuccugucccccgugcgcgucccgaacuacaaccugaucaucauggacgaggcccacuucaccgaccccgcgagcaucgccgcccggggguacaucuccacccgcgugggcaugggcgaggccgcggccaucuucaugaccgccacgccgcccgggaccgccgacgccuucccgcagagcaacgcgcccauccaggacgaggagcgcgacauccccgagcgguccuggaacagcggcaacgaguggaucaccgacuucgccgggaagaccgugugguucguccccuccaucaaggccggcaacgacaucgccaacugccuccgcaagaacgggaagaaggugauccagcugagccggaagacguucgacaccgaguaccagaagaccaagcugaacgacugggacuucguggucaccacggacaucuccgagaugggcgccaacuucaaggcggaccgcgugaucgacccgcggcgcugccucaagcccgugauccugaccgacggccccgagcgggucauccuggccgggcccaugccggugaccgccgccagcgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgcgagaaguccgcggccaucgacggcgaguaccggcugaagggcgagagccgcaagaccuucgucgagcugaugcggcgcggggaccuccccguguggcuggcccacaagguggccuccgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccgcacguacagcgacccgcuggcgcucaaggaguucaaggacuucgccgccggccggaaguccaucgcccuggaccuggugaccgagaucgggcgcguccccagccaccucgcccaccggacccgcaacgcgcuggacaaccuggugaugcuccacaccagcgagcacggcgggcgggccuaccgccacgccguggaggagcugcccgagacgauggagacccugcuccugcugggccucaugauccugcugaccgggggcgccaugcuguuccugaucuccggcaaggggaucggcaagaccagcaucgggcugaucugcgucaucgccuccagcggcaugcucuggauggcggagaucccgcugcaguggaucgccuccgccaucgugcuggaguucuucaugauggugcuccugauccccgagcccgagaagcagcggacgccccaggacaaccagcuggccuacgucgugaucgggauccucacccuggccgcgaucaucgccgccaacgagaugggccugcucgagaccaccaagcgcgaccugggcaugagcaaggagccggggguggucucccccacgagcuaccuggacguggaccuccaccccgccuccgcguggacccuguacgccguggccaccaccgucaucacgcccaugcugcggcacaccaucgagaacagcaccgccaacgugucccucgccgcgaucgccaaccaggccgugguccugaugggccuggacaagggguggccgaucagcaagauggaccucggcgugccccugcuggcccucgggugcuacucccaggugaacccccugacccugacggccgcgguccuccugcugaucacccacuacgccaucaucggccccggccuccaggccaaggccacccgcgaggcccagaagcggaccgcggccgggaucaugaagaacccgacgguggacggcaucaugaccaucgaccuggaccccgugaucuacgacagcaaguucgagaagcagcuggggcaggucaugcuccuggugcugugcgccgugcagcuccugcugaugcgcaccuccugggcccucugcgaggcgcugacccuggccacgggccccaucaccacccucugggagggcagccccgggaaguucuggaacaccacgaucgccgucuccauggccaacaucuuccggggcagcuaccuggccggggcgggccuggccuucuccaucaugaaguccguggggaccggcaagcgcggcaccgggagccagggcgagacccucggggagaaguggaagaagaagcugaaccagcugucccggaaggaguucgaccucuacaagaaguccggcaucaccgagguggaccgcacggaggccaaggaggggcugaagcggggcgagaucacccaccacgccgucucccgcggcagcgccaagcugcagugguucguggagcggaacauggugaucccggaggggcgcgucaucgaccucggcugcgggcggggcgggugguccuacuacugcgcgggccugaagaaggugaccgaggugcgcggcuacaccaagggcgggcccgggcacgaggagcccguccccaugagcacguacggcuggaacaucgugaagcugauguccgggaaggacguguucuaccucccgcccgagaagugcgacacccugcugugcgacaucggcgagagcucccccagccccaccgucgaggagucccgcaccauccgggugcugaagaugguggagccguggcucaagaacaaccaguucugcaucaagguccugaaccccuacaugcccacggugaucgagcaccuggagcgccuccagcggaagcacggcgggaugcuggugcgcaacccccugagccggaacuccacccacgagauguacuggaucagcaacggcaccgggaacaucgucgccuccgugaacauggugagccgccuccugcugaaccgguucaccaugacgcaccgccggccgaccaucgagaaggacgucgaccucggcgccggcacccgccacgugaacgccgagcccgagacccccaacauggacgugaucggggagcggaucaagcgcaucaaggaggagcacaacuccacguggcacuacgacgacgagaacccguacaagaccugggccuaccacggcagcuacgaggucaaggcgaccggguccgccagcagcaugaucaacggcguggugaagcugcugaccaagcccugggacgucgugcccauggucacgcagauggccaugaccgacaccacccccuucgggcagcagcggguguucaaggagaagguggacacgcgcaccccgcgguccaugcccggcacccgccgggucaugggcaucaccgccgaguggcucuggcgcacgcuggggcggaacaagaagccccgccugugcacccgcgaggaguucaccaagaaggugcggaccaacgcggccaugggcgccguguucacggaggagaaccaguggaacagcgccaaggccgcggucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggccaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgcgauguacgccgacgacaccgccgggugggacacccggaucaccgaggacgaccugcacaacgaggagaagaucacgcagcagauggacccggagcaccgccggcucgccaacgccaucuucaagcugaccuaccagaacaagguggugaagguccagcgccccacccccaccggcaccgugauggacaucaucucccggaaggaccagcgcggcagcggccaggugggcacguacgggcugaacaccuucaccaacauggaggcgcagcucauccggcagauggagggcgaggggguccuguccaaggccgaccuggagaacccccaccucccggagaagaagaucacccaguggcuggagacgaagggcguggagcgccugaagcggauggccaucagcggcgacgacugcguggucaagcccaucgacgaccgcuucgccaacgcccuccuggcgcugaacgacauggggaaggugcggaaggacaucccccaguggcagcccuccaagggcuggcacgacuggcagcaggucccguucugcagccaccacuuccacgagcucaucaugaaggacgggcgcaagcuggucgugcccugccggccccaggacgagcugaucggccgcgcccgcaucucccagggggccggcuggagccuccgggagaccgccugccugggcaaggcguacgcccagauguggucccugauguacuuccaccgccgggaccuccgccuggccagcaacgccaucugcuccgccgugcccguccacugggugccgaccagccggaccacguggagcauccacgcgcaccaccaguggaugaccaccgaggacaugcugaccguguggaaccgcgucuggaucgaggacaaccccuggauggaggacaagacgcccgugaccaccugggaggacgugcccuaccucgggaagcgggaggaccaguggugcggcucccugaucgggcugaccagccgcgccacgugggcccagaacaucccgaccgccauccagcagguccggucccucaucggcaacgaggaguuccuggacuacaugcccagcaugaagcgcuuccggaaggaggaggaguccgagggggccaucugguga

SEQ ID NO: 10091 - RNA, 9873 nt, Artificial Sequence
  derived and/or modified CDS sequence (opt1) from DENV-3__KJ189278__SS-prME
accagccucugccucaugaugauccugcccgccgcccuggcguuccaccucaccagccgggacggggagccccggaugaucguggggaagaacgagcggggcaagagccugcuguucaagaccgccuccgggaccaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagacguggaugagcgccgagggcgccuggcgccagguggagaagguggagaccugggcccugcgccacccgggguucaccauccucgcgcuguuccuggcccacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggcgacccuccggaagcugugcaucgagggcaagaucaccaacaucaccacggacagccgcugccccacccagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggcgacccugcccgaguacggcacgcuggggcucgagugcuccccgcgcaccggccuggacuucaacgagaugauccugcucaccaugaagaacaaggccuggauggugcaccggcagugguucuucgaccugccccugcccuggaccagcggcgccacgaccgagacccccaccuggaaccgcaaggagcuccuggugacguucaagaacgcccacgccaagaagcaggaggucguggugcuggggucccaggagggcgcgaugcacaccgcccucaccggggccaccgagauccagaacagcggcgggacguccaucuucgccggccaccugaagugccggcugaagauggacaagcucgagcugaagggcaugagcuacgccaugugcaccaacaccuucguccugaagaaggagguguccgagacccagcacgggacgauccucaucaagguggaguacaagggcgaggacgcgccgugcaagauccccuucagcaccgaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccacggcccggggcgcccgccggauggccauccugggcgacaccgcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacacguccaugagcuucuccugcaucgccaucgggaucaucacccucuaccugggcgccguggugcaggcggacauggggugcgucaucaacuggaagggcaaggagcugaagugcggcagcgggaucuucgugaccaacgaggugcacaccuggacggagcaguacaaguuccaggccgacucccccaagcgccucgccaccgccaucgccggcgcgugggagaacggggucugcggcauccgcagcaccacccggauggagaaccugcuguggaagcagaucgccaacgagcucaacuacauccugugggagaacaacgugaagcugacgguggucgugggggacaucaucggcgugcucgagcagggcaagcgcacccugacgccccagccgauggagcugaaguacuccuggaagaccugggggaaggccaagaucgucacggccgagacccagaacagcuccuucaucaucgacggccccaacacccccgagugccccagcgcgucccgggccuggaacgugugggagguggaggacuacggguucggcgucuucaccaccaacaucuggcuccgccugcgggagguguacacgcagcugugcgaccaccgccucaugagcgccgccgugaaggacgagcgggccguccacgcggacaugggcuacuggaucgagagccagaagaacggguccuggaagcuggagaaggccagccugaucgaggugaagaccugcaccuggccgaagucccacacccucuggagcaacggcgugcuggaguccgacaugaucauccccaagagccuggccgggcccaucucccagcacaaccaccgcccgggcuaccacacgcagaccgccgggcccuggcaccucggcaagcuggagcuggacuucaacuacugcgagggcaccaccgucgugaucacggagaacugcgggacccggggccccagccuccgcaccaccacgguguccgggaagcugauccacgaguggugcugccggagcugcacccugcccccgcuccgcuacaugggcgaggacgggugcugguacggcauggagauccggcccaucuccgagaaggaggagaacauggucaagagccugguguccgccggcagcgggaagguggacaacuucaccaugggcguccugugccucgcgauccuguucgaggaggugaugcgcgggaaguucggcaagaagcacaugaucgccgggguguucuucaccuucguccugcuccuguccggccagaucacguggcgggacauggcccacacccugaucaugaucggcagcaacgccuccgaccgcauggggaugggcgugaccuaccucgcccugaucgcgaccuucaagauccagcccuuccuggcccucggguucuuccugcggaagcugacgagccgcgagaaccuccugcugggcgugggccucgccauggccaccacccugcagcugcccgaggacaucgagcagauggcgaacgggaucgcccucggccugauggcccugaagcucaucacccaguucgagacguaccagcuguggaccgcccugaucagccugaccugcuccaacaccaucuucacgcugaccgucgccuggcggaccgcgacccugauccucgccggggugagccugcugccggucugccaguccagcuccaugcgcaagacggacuggcuccccauggccguggccgccaugggcgugccgccccucccgcuguucaucuucagccucaaggacacccugaagcgccgguccuggccccugaacgagggggucauggcggugggccucgugagcauccuggccuccagccugcuccgcaacgacguccccauggccggcccccugguggccgggggccugcucaucgccugcuacgugaucaccgggaccuccgcggaccugacggucgagaaggccgccgacaucaccugggaggaggaggccgagcagaccggcgugagccacaaccugaugaucaccguggacgacgacgggaccaugcggaucaaggacgacgagacggagaacauccucaccguccugcugaagaccgcccuccugaucguguccggcaucuucccguacagcauccccgcgacccugcucguguggcacacguggcagaagcagacccagcgcuccggcguccugugggacgugcccagcccgcccgagacccagaaggccgagcuggaggaggggguguaccggaucaagcagcagggcaucuucgggaagacccaggucggcgugggggugcagaaggagggcgucuuccacacgauguggcacgugacccgcggcgccgugcucaccuacaacgggaagcggcuggagcccaacugggccuccgucaagaaggaccugaucagcuacggcgggggcuggcgccucuccacccaguggcagaagggggaggagguccaggugaucgcggucgagcccggcaagaaccccaagaacuuccagacgaugcccggcaccuuccagaccaccacgggggagaucggcgccaucgcccuggacuucaagcccgggaccagcggcagccccaucaucaaccgggagggcaaggugguggggcuguacggcaacggggucgugaccaagaacggcggguacguguccggcaucgcccagaccaacgccgagccggacggccccacgcccgagcuggaggaggagauguucaagaagcgcaaccucaccaucauggaccugcaccccgggagcggcaagacccggaaguaccugccggcgaucguccgcgaggccaucaagcggcgccuccggacccugauccuggcccccacgcgcgugguggccgccgagauggaggaggcgcucaaggggcugcccauccgguaccagaccaccgccaccaaguccgagcacacgggccgcgagaucgucgaccugaugugccacgccaccuucaccaugcggcuccugagccccgugcgcgugccgaacuacaaccugaucaucauggacgaggcccacuucaccgaccccgccuccaucgcggcccggggguacaucagcacgcgcgucggcaugggcgaggccgccgcgaucuucaugaccgccacgccgcccgggaccgccgacgccuucccgcaguccaacgcccccauccaggacgaggagcgcgacauccccgagcggagcuggaacuccggcaacgaguggaucacggacuucgcggggaagaccgugugguucgugcccagcaucaaggccggcaacgacaucgccaacugccuccgcaagaacgggaagaaggucauccagcugucccggaagaccuucgacaccgaguaccagaagacgaagcugaacgacugggacuucguggugaccaccgacaucagcgagaugggcgccaacuucaaggccgaccgcgucaucgacccgcggcgcugccucaagcccgugauccugaccgacggccccgagcgggugauccuggcggggcccaugccggucaccgccgccuccgccgcccagcgccggggccgcguggggcggaacccccagaaggagaacgaccaguacaucuucacgggccagccccucaacaacgacgaggaccacgcgcacuggaccgaggccaagaugcugcuggacaacaucaacacccccgaggggaucaucccggcccucuucgagcccgagcgcgagaaguccgccgcgaucgacggcgaguaccggcugaagggcgagucccgcaagaccuucguggagcugaugcggcgcggggaccuccccgucuggcuggcccacaagguggccagcgagggcaucaaguacacggaccggaaguggugcuucgacgggcagcgcaacaaccagauccuggaggagaacauggacgucgagaucuggaccaaggagggcgagaagaagaagcuccggccccgcuggcuggacgcccgcaccuacuccgacccgcuggcccucaaggaguucaaggacuucgcggccggccgcaagagcaucgcccuggaccuggugaccgagaucgggcgcgugcccucccaccucgcccaccggacgcgcaacgcccuggacaaccuggucaugcuccacaccagcgagcacggcgggcgggcguaccgccacgccguggaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugcucuggauggccgagaucccgcugcaguggaucgcgagcgccaucguccuggaguucuucaugauggugcuccugauccccgagcccgagaagcagcggacgccccaggacaaccagcuggccuacguggucaucgggauccucacccuggccgccaucaucgcggccaacgagaugggccugcucgagacgaccaagcgcgaccugggcauguccaaggagccggggguggugagccccaccuccuaccuggacgucgaccuccaccccgccagcgccuggacccuguacgcgguggccacgaccgugaucacccccaugcugcggcacaccaucgagaacuccacggccaacgucagccucgccgccaucgcgaaccaggccguggugcugaugggccuggacaagggguggccgaucuccaagauggaccucggcgucccccugcuggcccucgggugcuacagccaggugaacccccugacccugaccgccgccgugcuccugcugaucacccacuacgcgaucaucggccccggccuccaggccaaggccacgcgcgaggcccagaagcggaccgccgcggggaucaugaagaacccgaccgucgacggcaucaugaccaucgaccuggaccccgugaucuacgacuccaaguucgagaagcagcugggccaggugaugcuccugguccugugcgccgugcagcuccugcugaugcgcacgagcugggcccucugcgaggcccugacccuggcgaccggccccaucaccacgcucugggagggcucccccgggaaguucuggaacaccaccaucgccgugagcauggccaacaucuuccggggcuccuaccuggccggggccggccuggcguucagcaucaugaaguccgucgggaccggcaagcgcggcaccgggagccagggcgagacgcucggggagaaguggaagaagaagcugaaccagcugagccggaaggaguucgaccucuacaagaaguccggcaucaccgagguggaccgcaccgaggccaaggaggggcugaagcggggcgagaucacccaccacgccgugagccgcggcuccgccaagcugcagugguucgucgagcggaacauggugaucccggaggggcgcgugaucgaccucggcugcgggcggggcggguggagcuacuacugcgccggccugaagaaggucacggaggugcgcggcuacaccaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccacgguggaggagagccgcaccauccggguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacccacgagauguacuggaucuccaacggcacggggaacaucguggcgagcgucaacauggugucccgccuccugcugaaccgguucaccaugacccaccgccggccgaccaucgagaaggacguggaccucggcgccggcacgcgccacgucaacgccgagcccgagacccccaacauggacgugaucggggagcggaucaagcgcaucaaggaggagcacaacagcaccuggcacuacgacgacgagaacccguacaagaccugggccuaccacggcuccuacgaggugaaggccacggggagcgcguccagcaugaucaacggcgucgugaagcugcugaccaagcccugggacgucgugcccauggugacccagauggccaugaccgacacgacccccuucgggcagcagcgggucuucaaggagaagguggacacccgcaccccgcggagcaugcccggcacgcgccgggugaugggcaucaccgccgaguggcucuggcgcacccuggggcggaacaagaagccccgccugugcacccgcgaggaguucacgaagaagguccggaccaacgccgcgaugggcgccguguucaccgaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacaccgccgggugggacacgcggaucaccgaggacgaccugcacaacgaggagaagaucacccagcagauggacccggagcaccgccagcucgccaacgccaucuucaagcugaccuaccagaacaaggucgugaaggugcagcggcccacccccacgggcaccgucauggacaucaucagccgcaaggaccagcggggcuccggccaggugggcaccuacgggcugaacaccuucacgaacauggaggcccagcucauccgccagauggagggcgagggggugcugagcaaggcggaccuggagaacccccaccucccggagaagaagaucacccaguggcuggagaccaagggcgucgagcggcugaagcgcauggccaucuccggcgacgacugcguggugaagcccaucgacgaccgguucgccaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcgcgcaucagccagggggccggcuggucccuccgcgagaccgccugccugggcaaggccuacgcgcagauguggagccugauguacuuccaccggcgcgaccuccggcuggccuccaacgccaucugcagcgccgugcccgugcacugggucccgacgucccgcaccaccuggagcauccacgcccaccaccaguggaugaccacggaggacaugcugaccguguggaaccggguguggaucgaggacaaccccuggauggaggacaagacccccgucaccacgugggaggacgugcccuaccucgggaagcgcgaggaccaguggugcggcagccugaucgggcugaccucccgggcgaccugggcccagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10092 - RNA, 9873 nt, Artificial Sequence
  derived and/or modified CDS sequence (opt1) from DENV-3__KJ189279__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggugacccugcccgaguacggcacccuggggcucgagugcuccccgcgcacgggccuggacuucaacgagaugauccugcucaccaugaagaacaaggcguggauggugcaccggcagugguucuucgaccugccccugcccuggaccagcggcgccaccacggagacccccaccuggaaccgcaaggagcuccuggucaccuucaagaacgcccacgccaagaagcaggagguggugguccuggggucccaggagggcgccaugcacacggcgcucaccggggccaccgagauccagaacagcggcgggaccuccaucuucgccggccaccugaagugccggcugaagauggacaagcucgagcugaagggcaugagcuacgccaugugcacgaacaccuucgugcugaagaaggagguguccgagacccagcacgggaccauccucaucaaggucgaguacaagggcgaggacgccccgugcaagauccccuucagcacggaggacgggcacggcaaggcgcacaacggccgccugaucaccgccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacacggccugggacuucggguccgugggcgggguccucaacagccugggcaagauggugcaccagaucuucggguccgcguacaccgcccuguucagcggcguguccugggucaugaagaucggcaucggggugcuccugaccuggaucggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcuccgccugcgggagguguacacccagcugugcgaccaccgccucaugagcgccgccaucaaggacgagcgggccgugcacgccgacaugggcuacuggaucgagagccagaagaacggguccuggaagcuggagaaggcgagccugaucgaggucaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggucaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgccauccuguucgaggaggucaugcgcgggaaguucggcaagaagcacaugaucgcggggguguucuucaccuucgugcugcuccuguccggccagaucaccuggcgggacauggcccacacgcugaucaugaucggcagcaacgccuccgaccgcauggggaugggcgucaccuaccucgcccugaucgccaccuucaagauccagcccuuccuggcgcucggguucuuccugcggaagcugaccagccgcgagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacgguggccuggcggaccgccacccugauccucgcgggggucagccugcugccggugugccaguccagcuccaugcgcaagaccgacuggcuccccauggccgucgccgccaugggcgugccgccccucccgcuguucaucuucagccucaaggacacgcugaagcgccgguccuggccccugaacgagggggugauggccgucggccucgugagcauccuggcguccagccugcuccgcaacgacgugcccauggccggcccccuggucgccgggggccugcucaucgccugcuacgugaucaccgggaccuccgccgaccugaccguggagaaggcggccgacaucacgugggaggaggaggccgagcagaccggcgucagccacaaccugaugaucaccguggacgacgacgggaccaugcggaucaaggacgacgagaccgagaacauccucacggugcugcugaagaccgcccuccugaucgucuccggcaucuucccguacagcauccccgccacccugcucguguggcacaccuggcagaagcagacgcagcgcuccggcgugcugugggacguccccagcccgcccgagacccagaaggcggagcuggaggaggggguguaccggaucaagcagcagggcaucuucgggaagacccaggugggcgucggggugcagaaggagggcguguuccacaccauguggcacgucacgcgcggcgccgugcucaccuacaacgggaagcggcuggagcccaacugggccuccgugaagaaggaccugaucagcuacggcgggggcuggcgccucuccacccaguggcagaagggggaggagguccaggugaucgccguggagcccggcaagaaccccaagaacuuccagaccaugcccggcacguuccagaccaccaccggggagaucggcgcgaucgcccuggacuucaagcccgggacgagcggcagccccaucaucaaccgggagggcaaggucguggggcuguacggcaacgggguggucaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggccaucgugcgcgaggcgaucaagcggcgccuccggacccugauccuggcccccacccgcgucguggccgccgagauggaggaggcccucaaggggcugcccauccgguaccagacgaccgcgaccaaguccgagcacaccggccgcgagaucguggaccugaugugccacgccacguucaccaugcggcuccugagccccguccgcgugccgaacuacaaccugaucaucauggacgaggcccacuucaccgaccccgccuccaucgccgcgcggggguacaucagcacccgcgugggcaugggcgaggccgccgccaucuucaugacggcgacgccgcccgggaccgccgacgccuucccgcaguccaacgcccccauccaggacgaggagcgcgacauccccgagcggagcuggaacuccggcaacgaguggaucaccgacuucgccgggaagacggucugguucgugcccagcaucaaggcgggcaacgacaucgccaacugccuccgcaagaacgggaagaaggugauccagcugucccggaagaccuucgacaccgaguaccagaagaccaagcugaacgacugggacuucgucgugacgaccgacaucagcgagaugggcgccaacuucaaggccgaccgcgugaucgacccgcggcgcugccucaagcccgucauccugaccgacggccccgagcgggugauccuggccgggcccaugccggugaccgcggccuccgccgcccagcgccggggccgcgucgggcggaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgcgagaaguccgccgccaucgacggcgaguaccggcugaagggcgagucccgcaagaccuucguggagcugaugcggcgcggggaccuccccguguggcuggcgcacaaggucgccagcgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacuccgacccgcuggcccucaaggaguucaaggacuucgccgcgggccgcaagagcaucgcccuggaccuggucaccgagaucgggcgcgugcccucccaccucgcccaccggacccgcaacgcccuggacaaccuggugaugcuccacacgagcgagcacggcgggcgggccuaccgccacgcggucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccacgaagcgcgaccugggcauguccaaggagccgggggucgugagccccaccuccuaccuggacguggaccuccaccccgccagcgccuggacccuguacgccgucgcgaccacggugaucacccccaugcugcggcacaccaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacgcugaccgccgccgugcuccugcugaucacccacuacgccaucaucggccccggccuccaggcgaaggccacccgcgaggcccagaagcggacggccgccgggaucaugaagaacccgaccguggacggcaucaugaccaucgaccuggaccccgucaucuacgacuccaaguucgagaagcagcugggccaggugaugcuccuggugcugugcgcgguccagcuccugcugaugcgcaccagcugggcccucugcgaggcccugacgcuggccaccggccccaucaccacccucugggagggcucccccgggaaguucuggaacacgaccaucgcggugagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucacggaggucgaccgcaccgaggcgaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccgcacgauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugucccggaacagcacccacgagauguacuggaucuccaacggcaccgggaacaucguggccagcgugaacauggucucccgccuccugcugaaccgguucacgaugacccaccgccggccgaccaucgagaaggacguggaccucggcgcgggcacccgccacgugaacgccgagcccgagacgcccaacauggacgucaucggggagcggaucaagcgcaucaaggaggagcacaacagcaccuggcacuacgacgacgagaacccguacaagaccugggccuaccacggcuccuacgaggugaaggccaccgggagcgccuccagcaugaucaacggcguggucaagcugcugacgaagcccugggacgugguccccauggugacccagauggcgaugaccgacaccacgcccuucgggcagcagcggguguucaaggagaaggucgacacccgcaccccgcggagcaugcccggcacccgccgggugaugggcaucacggccgaguggcucuggcgcacccuggggcggaacaagaagccccgccugugcacccgcgaggaguucaccaagaaggugcggacgaacgccgccaugggcgcggucuucaccgaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggucaaggugcagcggcccacccccaccggcacggugauggacaucaucagccgcaaggaccagcggggcuccgggcaggucggcaccuacgggcugaacaccuucaccaacauggaggcccagcucauccgccagauggagggcgagggggugcugagcaaggccgaccuggagaacccccaccucccggagaagaagaucacgcaguggcuggagaccaagggcguggagcggcugaagcgcauggcgaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggcgggcuggucccuccgcgagaccgccugccugggcaaggccuacgcccagauguggagccugauguacuuccaccggcgcgaccuccggcuggcguccaacgccaucugcagcgccguccccgugcacugggugccgaccucccgcacgaccuggagcauccacgcccaccaccaguggaugaccaccgaggacaugcugacggucuggaaccggguguggaucgaggacaaccccuggauggaggacaagacccccgugaccaccugggaggacguccccuaccucgggaagcgcgaggaccaguggugcggcagccugaucgggcugacgucccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10093 - RNA, 9873 nt, Artificial Sequence
  derived and/or modified CDS sequence (opt1) from DENV-3__KJ189280__SS-prME
accagccucugccucaugaugauccugcccgccgcccuggcguuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcggagcguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcuccgccugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggucaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgcgauccuguucgaggaggucaugcgcgggaaguucggcaagaagcacaugaucgccgggguguucuucaccuucgugcugcuccuguccggccagaucaccuggcgggacauggcccacacgcugaucaugaucggcagcaacgccuccgaccgcauggggaugggcgucaccuaccucgcccugaucgcgaccuucaagauccagcccuuccuggcccucggguucuuccugcggaagcugaccagccgcgagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccaucuucacccugacgguggccuggcggaccgcgacccugauccucgccggggucagccugcugccggugugccaguccagcuccaugcgcaagaccgacuggcuccccauggccgucgccgccaugggcgugccgccccucccgcuguucaucuucagccucaaggacacgcugaagcgccgguccuggccccugaacgagggggugauggcggucggccucgugagcauccuggccuccagccugcuccgcaacgacgugcccauggccggcccccuggucgccgggggccugcucaucgccugcuacgugaucaccgggaccuccgcggaccugaccguggagaaggccgccgacaucacgugggaggaggaggccgagcagaccggcgucagccacaaccugaugaucaccguggacgacgacgggaccaugcggaucaaggacgacgagaccgagaacauccucacggugcugcugaagaccgcccuccugaucgucuccggcaucuucccguacagcauccccgcgacccugcucguguggcacaccuggcagaagcagacgcagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgccgugcucaccuacaacgggaagcggcuggagcccaacugggccuccgugaagaaggaccugaucagcuacggcgggggcuggcgccucuccacccaguggcagaagggggaggagguccaggugaucgcgguggagcccggcaagaaccccaagaacuuccagaccaugcccggcacguuccagaccaccaccggggagaucggcgccaucgcccuggacuucaagcccgggacgagcggcagccccaucaucaaccgggagggcaaggucguggggcuguacggcaacgggguggucaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggcgaucgugcgcgaggccaucaagcggcgccuccggacccugauccuggcccccacccgcgucguggccgccgagauggaggaggcgcucaaggggcugcccauccgguaccagacgaccgccaccaaguccgagcacaccggccgcgagaucguggaccugaugugccacgccacguucaccaugcggcuccugagccccguccgcgugccgaacuacaaccugaucaucauggacgaggcccacuucaccgaccccgccuccaucgcggcccggggguacaucagcacccgcgugggcaugggcgaggccgccgcgaucuucaugacggccacgccgcccgggaccgccgacgccuucccgcaguccaacgcccccauccaggacgaggagcgcgacauccccgagcggagcuggaacuccggcaacgaguggaucaccgacuucgcggggaagacggucugguucgugcccagcaucaaggccggcaacgacaucgccaacugccuccgcaagaacgggaagaaggugauccagcugucccggaagaccuucgacaccgaguaccagaagaccaagcugaacgacugggacuucgucgugacgaccgacaucagcgagaugggcgccaacuucaaggccgaccgcgugaucgacccgcggcgcugccucaagcccgucauccugaccgacggccccgagcgggugauccuggcggggcccaugccggugaccgccgccuccgccgcccagcgccggggccgcgucgggcggaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgcgagaaguccgccgcgaucgacggcgaguaccggcugaagggcgagucccgcaagaccuucguggagcugaugcggcgcggggaccuccccguguggcuggcccacaaggucagcuccgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacagcgacccgcuggcccucaaggaguucaaggacuucgccgcgggccggaaguccaucgcccuggaccuggucaccgagaucgggcgcgugcccagccaccucgcccaccggacccgcaacgcccuggacaaccuggugaugcuccacacgagcgagcacggcgggcgggccuaccgccacgcggucgaggagcugcccgagaccauggagacccugcuccugcugggccucaugauccugcugaccgggggcgccaugcuguuccugaucuccggcaaggggaucggcaagacgagcaucgggcugaucugcgugaucgccuccagcggcaugcucuggauggccgagaucccgcugcaguggaucgccuccgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccacgaagcgcgaccugggcaugagcaaggagccgggggucgugucccccaccagcuaccuggacguggaccuccaccccgccuccgccuggacccuguacgccgucgcgaccacggugaucacccccaugcugcggcacaccaucgagaacagcaccgccaacgugucccucgccgccaucgccaaccaggcggucgugcugaugggccuggacaagggguggccgaucagcaagauggaccucggcgugccccugcuggcccucgggugcuacucccaggucaacccccugacgcugaccgccgccgugcuccugcugaucacccacuacgccaucaucggccccggccuccaggcgaaggccacccgcgaggcccagaagcggacggccgccgggaucaugaagaacccgaccguggacggcaucaugaccaucgaccuggaccccgucaucuacgacagcaaguucgagaagcagcugggccaggugaugcuccuggugcugugcgcgguccagcuccugcugaugcgcaccuccugggcccucugcgaggcccugacgcuggccaccggccccaucaccacccucugggagggcagccccgggaaguucuggaacacgaccaucgcgguguccauggccaacaucuuccggggcagcuaccuggccggggccggccuggccuucuccaucaugaaguccguggggaccggcaagcgcggcaccgggagccagggcgagacccucggggagaaguggaagaagaagcugaaccagcugucccggaaggaguucgaccucuacaagaaguccggcaucacggaggucgaccgcaccgaggcgaaggaggggcugaagcggggcgagaucacccaccacgccgugucccgcggcagcgccaagcugcagugguucguggagcggaacauggucaucccggaggggcgcgugaucgaccucggcugcgggcggggcgggugguccuacuacugcgccggccugaagaaggugaccgagguccgcggcuacacgaagggcgggcccgggcacgaggagcccgugcccaugagcaccuacggcuggaacaucgugaagcugauguccgggaaggacgucuucuaccucccgcccgagaagugcgacacccugcugugcgacaucggcgagagcucccccagccccaccguggaggagucccgcacgauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugagccggaacuccacccacgagauguacuggaucagcaacggcaccgggaacaucguggccuccgugaacauggucagccgccuccugcugaaccgguucacgaugacccaccgccggccgaccaucgagaaggacguggaccucggcgcgggcacccgccacgugaacgccgagcccgagacgcccaacauggacgucaucggggagcggaucaagcgcaucaaggaggagcacaacuccaccuggcacuacgacgacgagaacccguacaagaccugggccuaccacggcagcuacgaggugaaggccaccggguccgccagcagcaugaucaacggcguggucaagcugcugacgaagcccugggacgugguccccauggugacccagauggcgaugaccgacaccacgcccuucgggcagcagcggguguucaaggagaaggucgacacccgcaccccgcgguccaugcccggcacccgccgggugaugggcaucacggccgaguggcucuggcgcacccuggggcggaacaagaagccccgccugugcacccgcgaggaguucaccaagaaggugcggacgaacgccgccaugggcgcggucuucaccgaggagaaccagugggacagcgccaaggccgccguggaggacgaggacuucuggaagcucguggaccgcgagcgggagcugcacaagcuggggaagugcggcuccugcgucuacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggucaaggugcagcggcccacccccaccggcacggugauggacaucaucucccgcaaggaccagcggggcagcgggcaggucggcaccuacgggcugaacaccuucaccaacauggaggcccagcucauccgccagauggagggcgagggggugcuguccaaggccgaccuggagaacccccaccucccggagaagaagaucacgcaguggcuggagaccaagggcguggagcggcugaagcgcauggcgaucagcggcgacgacugcgucgugaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcugguggugcccugccgcccccaggacgagcugaucggccgggcccgcaucucccagggggcgggcuggagccuccgcgagaccgccugccugggcaaggccuacgcccagauguggucccugauguacuuccaccggcgcgaccuccggcuggcgagcaacgccaucugcuccgccguccccgugcacugggugccgaccagccgcacgaccuggagcauccacgcccaccaccaguggaugaccaccgaggacaugcugacggucuggaaccggguguggaucgaggacaaccccuggauggaggacaagacccccgugaccaccugggaggacguccccuaccucgggaagcgcgaggaccaguggugcggcucccugaucgggcugacgagccgggccaccugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10094 - RNA, 9873 nt, Artificial Sequence
  derived and/or modified CDS sequence (opt1) from DENV-3__KJ189281__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgugacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcuccgccugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggucaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgcgauccuguucgaggaggucaugcgcgggaaguucggcaagaagcacaugaucgccgggguguucuucaccuucgugcugcuccuguccggccagaucaccuggcgggacauggcccacacgcugaucaugaucggcagcaacgccuccgaccgcauggggaugggcgucaccuaccucgcccugaucgcgaccuucaagauccagcccuuccuggugcucggguucuuccugcggaagcugaccagccgcgagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacggucgccuggcggaccgccacccugauccucgcgggggugagccugcugccggucugccaguccagcuccaugcgcaagaccgacuggcuccccauggccguggccgccaugggcgugccgccccucccgcuguucaucuucagccucaaggacacgcugaagcgccgguccuggccccugaacgagggggucauggccgugggccucgugagcauccuggcguccagccugcuccgcaacgacguccccauggccggcccccugguggccgggggccugcucaucgccugcuacgugaucaccgggaccuccgccgaccugaccgucgagaaggcggccgacaucacgugggaggaggaggccgagcagaccggcgugagccacaaccugaugaucaccguggacgacgacgggaccaugcggaucaaggacgacgagaccgagaacauccucacgguccugcugaagaccgcccuccugaucguguccggcaucuucccguacagcauccccgccacccugcucguguggcacaccuggcagaagcagacgcagcgcuccggcguccugugggacgugcccagcccgcccgagacccagaaggcggagcuggaggaggggguguaccggaucaagcagcagggcaucuucgggaagacccaggucggcgugggggugcagaaggagggcgucuuccacaccauguggcacgugacgcgcggcgccgugcucaccuacaacgggaagcggcuggagcccaacugggccuccgucaagaaggaccugaucagcuacggcgggggcuggcgccucuccacccaguggcagaagggggaggagguccaggugaucgccgucgagcccggcaagaaccccaagaacuuccagaccaugcccggcacguuccagaccaccaccggggagaucggcgcgaucgcccuggacuucaagcccgggacgagcggcagccccaucaucaaccgggagggcaaggugguggggcuguacggcaacggggucgugaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggccaucguccgcgaggcgaucaagcggcgccuccggacccugauccuggcccccacccgcgugguggccgccgagauggaggaggcccucaaggggcugcccauccgguaccagacgaccgcgaccaaguccgagcacaccggccgcgagaucgucgaccugaugugccacgccacguucaccaugcggcuccugagccccgugcgcgugccgaacuacaaccugaucaucauggacgaggcccacuucaccgaccccgccuccaucgccgcgcggggguacaucagcacccgcgucggcaugggcgaggccgccgccaucuucaugacggcgacgccgcccgggaccgccgacgccuucccgcaguccaacgcccccauccaggacgaggagcgcgacauccccgagcggagcuggaacuccggcaacgaguggaucaccgacuucgccgggaagacggugugguucgugcccagcaucaaggcgggcaacgacaucgccaacugccuccgcaagaacgggaagaaggucauccagcugucccggaagaccuucgacaccgaguaccagaagaccaagcugaacgacugggacuucguggugacgaccgacaucagcgagaugggcgccaacuucaaggccgaccgcgucaucgacccgcggcgcugccucaagcccgugauccugaccgacggccccgagcgggugauccuggccgggcccaugccggucaccgcggccuccgccgcccagcgccggggccgcguggggcggaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgcgagaaguccgccgccaucgacggcgaguaccggcugaagggcgagucccgcaagaccuucguggagcugaugcggcgcggggaccuccccgucuggcuggcgcacaagguggccagcgagggcaucaaguacaccgaccggaaguggugcuucgacgggcagcgcaacaaccagauccuggaggagaacauggacgucgagaucuggacgaaggagggcgagaagaagaagcuccggccccgcuggcuggacgcccgcaccuacuccgacccgcuggcccucaaggaguucaaggacuucgccgcgggccgcaagagcaucgcccuggaccuggugaccgagaucgggcgcgugcccucccaccucgcccaccggacccgcaacgcccuggacaaccuggucaugcuccacacgagcgagcacggcgggcgggccuaccgccacgcgguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgccagcgcgaucguccuggaguucuucaugauggugcuccugauccccgagcccgagaagcagcggacgccccaggacaaccagcuggccuacguggucaucgggauccucacccuggccgccaucaucgccgcgaacgagaugggccugcucgagaccacgaagcgcgaccugggcauguccaaggagccggggguggugagccccaccuccuaccuggacgucgaccuccaccccgccagcgccuggacccuguacgccguggcgaccacggugaucacccccaugcugcggcacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacgcugaccgccgccgugcuccugcugaucacccacuacgccaucaucggccccggccuccaggcgaaggccacccgcgaggcccagaagcggacggccgccgggaucaugaagaacccgaccgucgacggcaucaugaccaucgaccuggaccccgugaucuacgacuccaaguucgagaagcagcugggccaggugaugcuccugguccugugcgcggugcagcuccugcugaugcgcaccagcugggcccucugcgaggcccugacgcuggccaccggccccaucaccacccucugggagggcucccccgggaaguucuggaacacgaccaucgcggugagcauggccaacaucuuccggggcuccuaccuggccggggccggccuggccuucagcaucaugaaguccgucgggaccggcaagcgcggcaccgggagccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgugagccgcggcuccgccaagcugcagugguucgucgagcggaacauggugaucccggaggggcgcgugaucgaccucggcugcgggcggggcggguggagcuacuacugcgccggccugaagaaggucaccgaggugcgcggcuacacgaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccaccguggaggagagccgcacgauccggguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacccacgagauguacuggaucuccaacggcaccgggaacaucguggccagcgucaacauggugucccgccuccugcugaaccgguucacgaugacccaccgccggccgaccaucgagaaggacguggaccucggcgcgggcacccgccacgucaacgccgagcccgagacgcccaacauggacgugaucggggagcggaucaagcgcaucaaggaggagcacaacagcaccuggcacuacgacgacgagaacccguacaagaccugggccuaccacggcuccuacgaggugaaggccaccgggagcgccuccagcaugaucaacggcgucgugaagcugcugacgaagcccugggacgucgugcccauggugacccagauggcgaugaccgacaccacgcccuucgggcagcagcgggucuucaaggagaagguggacacccgcaccccgcggagcaugcccggcacccgccgggugaugggcaucacggccgaguggcucuggcgcacccuggggcggaacaagaagccccgccugugcacccgcgaggaguucaccaagaagguccggacgaacgccgccaugggcgcgguguucaccgaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaaggucgugaaggugcagcggcccacccccaccggcacggucauggacaucaucagccgcaaggaccagcggggcuccggccaggugggcaccuacgggcugaacaccuucaccaacauggaggcccagcucauccgccagauggagggcgagggggugcugagcaaggccgaccuggagaacccccaccucccggagaagaagaucacgcaguggcuggagaccaagggcgucgagcggcugaagcgcauggcgaucuccggcgacgacugcguggugaagcccaucgacgaccgguucgccaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggcgggcuggucccuccgcgagaccgccugccugggcaaggccuacgcccagauguggagccugauguacuuccaccggcgcgaccuccggcuggcguccaacgccaucugcagcgccgugcccgugcacugggucccgaccucccgcacgaccuggagcauccacgcccaccaccaguggaugaccaccgaggacaugcugacgguguggaaccggguguggaucgaggacaaccccuggauggaggacaagacccccgucaccaccugggaggacgugcccuaccucgggaagcgcgaggaccaguggugcggcagccugaucgggcugacgucccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10095 - RNA, 9873 nt, Artificial Sequence
  derived and/or modified CDS sequence (opt1) from DENV-3__KJ189282__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcauccucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgugugggaggucgaggacuacggguucggcguguucaccaccaacaucuggcuccgccugcgggaggccuacacccagcugugcgaccaccgccucaugagcgccgccgugaaggacgagcgggcgguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccgucgugaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccugguguccgcgggcagcgggaagguggacaacuucaccaugggcguccugugccucgccauccuguucgaggaggugaugcgcgggaaguucggcaagaagcacaugaucgccgggguguucuucaccuucguccugcuccuguccggccagaucaccuggcgggacauggcccacacgcugaucaugaucggcagcaacgccuccgaccgcauggggaugggcgugaccuaccucgcgcugaucgccaccuucaagauccagcccuuccuggcccucggguucuuccugcggaagcugaccagccgcgagaaccuccugcugggcgugggccucgccauggcgacgacccugcagcugcccgaggacaucgagcagauggccaacgggaucgcccucggccugauggcccugaagcucaucacccaguucgagaccuaccagcuguggacggcccugaucagccugaccugcuccaacaccaucuucacccugacggucgcguggcggaccgccacccugauccucgccggggugagccugcugccggugugccaguccagcuccaugcgcaagaccgacuggcuccccauggccgucgccgcgaugggcgugccgccccucccgcuguucaucuucagccucaaggacacgcugaagcgccgguccuggccccugaacgagggggucauggccgugggccucgugagcauccuggccuccagccugcuccgcaacgacguccccauggccggcccccugguggccgggggccugcucaucgcgugcuacgugaucaccgggaccuccgccgaccugaccgucgagaaggccgccgacaucacgugggaggaggaggccgagcagaccggcgugagccacaaccugaugaucaccguggacgacgacgggaccaugcggaucaaggacgacgagaccgagaacauccucacgguccugcugaagaccgcgcuccugaucguguccggcaucuucccguacagcauccccgccacccugcucguguggcacaccuggcagaagcagacgcagcgcuccggcguccugugggacgugcccagcccgcccgagacccagaaggccgagcuggaggaggggguguaccggaucaagcagcagggcaucuucgggaagacccaggucggcgugggggugcagaaggagggcgucuuccacaccauguggcacgugacgcgcggcgccgugcucaccuacaacgggaagcggcuggagcccaacugggcguccgucaagaaggaccugaucagcuacggcgggggcuggcgccucuccacccaguggcagaagggggaggagguccaggugaucgccgucgagcccggcaagaaccccaagaacuuccagaccaugcccggcacguuccagaccaccaccggggagaucggcgccaucgcccuggacuucaagcccgggacgagcggcagccccaucaucaaccgggagggcaaggugguggggcuguacggcaacggggucgugaccaagaacggcggguacguguccggcaucgcccagaccaacgcggagccggacggccccacccccgagcuggaggaggagauguucaagaagcgcaaccucacgaucauggaccugcaccccgggagcggcaagacccggaaguaccugccggccaucguccgcgaggccaucaagcggcgccuccggacccugauccuggcccccacccgcgugguggccgcggagauggaggaggcccucaaggggcugcccauccgguaccagacgaccgccaccaaguccgagcacaccggccgcgagaucgucgaccugaugugccacgccacguucaccaugcggcuccugagccccgugcgcgugccgaacuacaaccugaucaucauggacgaggcccacuucaccgaccccgcguccaucgccgcccggggguacaucagcacccgcgucggcaugggcgaggccgcggccaucuucaugacggccacgccgcccgggaccgccgacgccuucccgcaguccaacgcgcccauccaggacgaggagcgcgacauccccgagcggagcuggaacuccggcaacgaguggaucaccgacuucgccgggaagacggugugguucgugcccagcaucaaggccggcaacgacaucgccaacugccuccgcaagaacgggaagaaggucauccagcugucccggaagaccuucgacaccgaguaccagaagaccaagcugaacgacugggacuucguggugacgaccgacaucagcgagaugggcgccaacuucaaggcggaccgcgucaucgacccgcggcgcugccucaagcccgugauccugaccgacggccccgagcgggugauccuggccgggcccaugccggucaccgccgccuccgccgcgcagcgccggggccgcguggggcggaacccccagaaggagaacgaccaguacaucuucaccggccagccccucaacaacgacgaggaccacgcccacuggacggaggccaagaugcugcuggacaacaucaacacccccgaggggaucaucccggcccucuucgagcccgagcgcgagaaguccgcggccaucgacggcgaguaccggcugaagggcgagucccgcaagaccuucguggagcugaugcggcgcggggaccuccccgucuggcuggcccacaagguggccagcgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacuccgacccgcuggcgcucaaggaguucaaggacuucgccgccggccgcaagagcaucgcccuggaccuggucaccgagaucgggcgcgugcccucccaccucgcccaccggacccgcaacgcgcuggacaaccuggucaugcuccacacgagcgagcacggcgggcgggccuaccgccacgccguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggcggagaucccgcugcaguggaucgccagcgccaucguccuggaguucuucaugauggugcuccugauccccgagcccgagaagcagcggacgccccaggacaaccagcuggccuacguggucaucgggauccucacccuggccgcgaucaucgccgccaacgagaugggccugcucgagaccacgaagcgcgaccugggcauguccaaggagccggggguggugagccccaccuccuaccuggacgucgaccuccaccccgccagcgcguggacccuguacgccguggccaccacggugaucacccccaugcugcggcacaccaucgagaacuccaccgccaacgucagccucgccgcgaucgccaaccaggccguggugcugaugggccuggacaagggguggccgaucuccaagauggaccucggcgucccccugcuggcccucgggugcuacagccaggugaacccccugacgcugaccgccgcggugcuccugcugaucacccacuacgccaucaucggccccggccuccaggccaaggccacccgcgaggcccagaagcggacggcggccgggaucaugaagaacccgaccgucgacggcaucaugaccaucgaccuggaccccgugaucuacgacuccaaguucgagaagcagcugggccaggugaugcuccugguccugugcgccgugcagcuccugcugaugcgcaccagcugggcccucugcgaggcgcugacgcuggccaccggccccaucaccacccucugggagggcucccccgggaaguucuggaacacgaccaucgccgugagcauggccaacaucuuccggggcuccuaccuggccggggcgggccuggccuucagcaucaugaaguccgucgggaccggcaagcgcggcaccgggagccagggcgagacccucggggagaaguggaagaagaagcugaaccagcugagccggaaggaguucgaccucuacaagaaguccggcaucacggagguggaccgcaccgaggccaaggaggggcugaagcggggcgagaucacccaccacgccgugagccgcggcuccgccaagcugcagugguucgucgagcggaacauggugaucccggaggggcgcgugaucgaccucggcugcgggcggggcggguggagcuacuacugcgcgggccugaagaaggucaccgaggugcgcggcuacacgaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccaccguggaggagagccgcacgauccggguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacccacgagauguacuggaucuccaacggcaccgggaacaucguggccagcgucaacauggugucccgccuccugcugaaccgguucacgaugacccaccgccggccgaccaucgagaaggacguggaccucggcgccggcacccgccacgucaacgccgagcccgagacgcccaacauggacgugaucggggagcggaucaagcgcaucaaggaggagcacaacagcaccuggcacuacgacgacgagaacccguacaagaccugggccuaccacggcuccuacgaggugaaggcgaccgggagcgccuccagcaugaucaacggcgucgugaagcugcugacgaagcccugggacgugguccccauggugacccagauggccaugaccgacaccacgcccuucgggcagcagcgggucuucaaggagaagguggacacccgcaccccgcggagcauggccggcacccgccgggugaugggcaucacggcggaguggcucuggcgcacccuggggcggaacaagaagccccgccugugcacccgcgaggaguucaccaagaagguccggacgaacgccgccaugggcgccguguucaccgaggagaaccagugggacuccgccaaggcggccguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggccaucugguacauguggcugggcgcccgcuaccuggaguucgaggcgcucggguuccugaacgaggaccacugguucagccgggagaacuccuacagcggcguggagggggagggccugcacaagcucggcuacauccugcgcgacaucuccaagauccccgggggcgccauguacgccgacgacaccgccgggugggacacccggaucacggaggacgaccugcacaacgaggagaagaucacccagcagauggaccccgagcaccgccagcucgccaacgcgaucuucaagcugaccuaccagaacaaggucgugaaggugcagcggccgacccccaccggcacggucauggacaucaucagccgcaaggaccagcggggcuccggccaggugggcaccuacgggcugaacaccuucaccaacauggaggcccagcucauccgccagauggagggcgagggggugcugagcaaggccgaccuggagaacccccaccuccccgagaagaagaucacgcaguggcuggagaccaagggcgucgagcggcugaagcgcauggccaucuccggcgacgacugcguggugaagccgaucgacgaccgguucgccaacgcgcuccuggcccugaacgacauggggaagguccgcaaggacaucccccaguggcagcccagcaagggcuggcacgacuggcagcagguccccuucugcucccaccacuuccacgagcucaucaugaaggacgggcggaagcugguggucccgugccgcccccaggacgagcugaucggccgggcccgcaucagccagggggccggcuggucccuccgcgagaccgcgugccugggcaaggccuacgcccagauguggagccugauguacuuccaccggcgcgaccuccggcuggccuccaacgccaucugcagcgcggugcccgugcacuggguccccaccucccgcacgaccuggagcauccacgcccaccaccaguggaugaccaccgaggacaugcugacgguguggaaccggguguggaucgaggacaacccguggauggaggacaagacccccgucaccaccugggaggacgugcccuaccucgggaagcgcgaggaccaguggugcggcagccugaucgggcugacgucccgggccaccugggcccagaacauccccaccgccauccagcagguccgcagccucaucggcaacgaggaguuccuggacuacaugccguccaugaagcgguuccgcaaggaggaggagagcgagggggcgaucugguga

SEQ ID NO: 10096 - RNA, 9873 nt, Artificial Sequence
  derived and/or modified CDS sequence (opt1) from DENV-3__KJ189283__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcuccgccugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggucaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgcgauccuguucgaggaggucaugcgcgggaaguucggcaagaagcacaugaucgccgggguguucuucaccuucgugcugcuccuguccggccagaucaccuggcgggacauggcccacacgcugaucaugaucggcagcaacgccuccgaccgcauggggaugggcgucaccuaccucgcccugaucgcgaccuucaagauccagcccuuccuggcccucggguucuuccugcggaagcugaccagccgcgagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaagaccaucuucacccugacgguggccuggcggaccgcgacccugauccucgccggggucagccugcugccggugugccaguccagcuccaugcgcaagaccgacuggcuccccauggccgucgccgccaugggcgugccgccccucccgcuguucaucuucagccucaaggacacgcugaagcgccgguccuggccccugaacgagggggugauggcggucggccucgugagcauccuggccuccagccugcuccgcaacgacgugcccauggccggcccccuggucgccgggggccugcucaucgccugcuacgugaucaccgggaccuccgcggaccugaccguggagaaggccgccgacaucacgugggaggaggaggccgagcagaccggcgucagccacaaccugaugaucaccguggacgacgacgggaccaugcggaucaaggacgacgagaccgagaacauccucacggugcugcugaagaccgcccuccugaucgucuccggcaucuucccguacagcauccccgcgacccugcucguguggcacaccuggcagaagcagacgcagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgccgugcucaccuacaacgggaagcggcuggagcccaacugggccuccgugaagaaggaccugaucagcuacggcgggggcuggcgccucuccacccaguggcagaagggggaggagguccaggugaucgcgguggagcccggcaagaaccccaagaacuuccagaccaugcccggcacguuccagaccaccaccggggagaucggcgccaucgcccuggacuucaagcccgggacgagcggcagccccaucaucaaccgggagggcaaggucguggggcuguacggcaacgggguggucaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggcgaucgugcgcgaggccaucaagcggcgccuccggacccugauccuggcccccacccgcgucguggccgccgagauggaggaggcgcucaaggggcugcccauccgguaccagacgaccgccaccaaguccgagcacaccggccgcgagaucguggaccugaugugccacgccacguucaccaugcggcuccugagccccguccgcgugccgaacuacaaccugaucaucauggacgaggcccacuucaccgaccccgccuccaucgcggcccggggguacaucagcacccgcgugggcaugggcgaggccgccgcgaucuucaugacggccacgccgcccgggaccgccgacgccuucccgcaguccaacgcccccauccaggacgaggagcgcgacauccccgagcggagcuggaacuccggcaacgaguggaucaccgacuucgcggggaagacggucugguucgugcccagcaucaaggccggcaacgacaucgccaacugccuccgcaagaacgggaagaaggugauccagcugucccggaagaccuucgacaccgaguaccagaagaccaagcugaacgacugggacuucgucgugacgaccgacaucagcgagaugggcgccaacuucaaggccgaccgcgugaucgacccgcggcgcugccucaagcccgucauccugaccgacggccccgagcgggugauccuggcggggcccaugccggugaccgccgccuccgccgcccagcgccggggccgcgucgggcggaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgcgagaaguccgccgcgaucgacggcgaguaccggcugaagggcgagucccgcaagaccuucguggagcugaugcggcgcggggaccuccccguguggcuggcccacaaggucgccagcgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacuccgacccgcuggcccucaaggaguucaaggacuucgcggccggccgcaagagcaucgcccuggaccuggucaccgagaucgggcgcgugcccucccaccucgcccaccggacccgcaacgcccuggacaaccuggugaugcuccacacgagcgagcacggcgggcgggcguaccgccacgccgucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucgugcuggaguucuucaugaugguccuccugauccccgagcccgagaagcagcggacgccccaggacaaccagcuggccuacguggugaucgggauccucacccuggccgccaucaucgcggccaacgagaugggccugcucgagaccacgaagcgcgaccugggcauguccaaggagccgggggucgugagccccaccuccuaccuggacguggaccuccaccccgccagcgccuggacccuguacgcggucgccaccacggugaucacccccaugcugcggcacaccaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacgcugaccgccgccgugcuccugcugaucacccacuacgcgaucaucggccccggccuccaggccaaggccacccgcgaggcccagaagcggacggccgcggggaucaugaagaacccgaccguggacggcaucaugaccaucgaccuggaccccgucaucuacgacuccaaguucgagaagcagcugggccaggugaugcuccuggugcugugcgccguccagcuccugcugaugcgcaccagcugggcccucugcgaggcccugacgcuggcgaccggccccaucaccacccucugggagggcucccccgggaaguucuggaacacgaccaucgccgugagcauggccaacaucuuccggggcuccuaccuggccggggccggccuggcguucagcaucaugaaguccguggggaccggcaagcgcggcaccgggagccagggcgagacccucggggagaaguggaagaagaagcugaaccagcugagccggaaggaguucgaccucuacaagaaguccggcaucacggaggucgaccgcaccgaggccaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccgcacgauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugucccggaacagcacccacgagauguacuggaucuccaacggcaccgggaacaucguggcgagcgugaacauggucucccgccuccugcugaaccgguucacgaugacccaccgccggccgaccaucgagaaggacguggaccucggcgccggcacccgccacgugaacgccgagcccgagacgcccaacauggacgucaucggggagcggaucaagcgcaucaaggaggagcacaacagcaccuggcacuacgacgacgagaacccguacaagaccugggccuaccacggcuccuacgaggugaaggccaccgggagcgcguccagcaugaucaacggcguggucaagcugcugacgaagcccugggacgugguccccauggugacccagauggccaugaccgacaccacgcccuucgggcagcagcggguguucaaggagaaggucgacacccgcaccccgcggagcaugcccggcacccgccgggugaugggcaucacggccgaguggcucuggcgcacccuggggcggaacaagaagccccgccugugcacccgcgaggaguucaccaagaaggugcggacgaacgccgcgaugggcgccgucuucaccgaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacaccgccgggugggacacccggaucacggaggacgaccugcacaacgaggagaagaucacccagcagauggacccggagcaccgccagcucgccaacgccaucuucaagcugaccuaccagaacaagguggucaaggugcagcggcccacccccaccggcacggugauggacaucaucagccgcaaggaccagcggggcuccgggcaggucggcaccuacgggcugaacaccuucaccaacauggaggcccagcucauccgccagauggagggcgagggggugcugagcaaggcggaccuggagaacccccaccucccggagaagaagaucacgcaguggcuggagaccaagggcguggagcggcugaagcgcauggccaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcgcgcaucagccagggggccggcuggucccuccgcgagaccgccugccugggcaaggccuacgcgcagauguggagccugauguacuuccaccggcgcgaccuccggcuggccuccaacgccaucugcagcgccguccccgugcacugggugccgaccucccgcacgaccuggagcauccacgcccaccaccaguggaugaccaccgaggacaugcugacggucuggaaccggguguggaucgaggacaaccccuggauggaggacaagacccccgugaccaccugggaggacguccccuaccucgggaagcgcgaggaccaguggugcggcagccugaucgggcugacgucccgggcgaccugggcccagaacauccucaccgccauccagcagguccgcagccugaucggcaacgaggaguuccuggacuacaugccguccaugaagcgguuccgcaaggaggaggagagcgagggggccaucugguga

SEQ ID NO: 10097 - RNA, 9873 nt, Artificial Sequence
  derived and/or modified CDS sequence (opt1) from DENV-3__KJ189284__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggugacccugcccgaguacggcacccuggggcucgagugcuccccgcgcacgggccuggacuucaacgagaugauccugcucaccaugaagaacaaggcguggauggugcaccggcagugguucuucgaccugccccugcccuggaccagcggcgccaccacggagacccccaccuggaaccgcaaggagcuccuggucaccuucaagaacgcccacgccaagaagcaggagguggugguccuggggucccaggagggcgccaugcacacggcgcucaccggggccaccgagauccagaacagcggcgggaccuccaucuucgccggccaccugaagugccggcugaagauggacaagcucgagcugaagggcaugagcuacgccaugugcacgaacaccuucgugcugaagaaggagguguccgagacccagcacgggaccauccucaucaaggucgaguacaagggcgaggacgccccgugcaagauccccuucagcacggaggacgggcacggcaaggcgcacaacggccgccugaucaccgccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacacggccugggacuucggguccgugggcgggguccucaacagccugggcaagauggugcaccagaucuucggguccgcguacaccgcccuguucagcggcguguccugggucaugaagaucggcaucggggugcuccugaccuggaucggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcuccgccugcgggagguguacacccagcugugcgaccaccgccucaugagcgccgccgugaaggacgagcgggccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccgucgugaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccugguguccgccggcagcgggaagguggacaacuucaccaugggcguccugugccucgccauccuguucgaggaggugaugcgcgggaaguucggcaagaagcacaugaucgcggggguguucuucaccuucguccugcuccuguccggccagaucaccuggcgggacauggcccacacgcugaucaugaucggcagcaacgccuccgaccgcauggggaugggcgugaccuaccucgcccugaucgccaccuucaagauccagcccuuccuggcgcucggguucuuccugcggaagcugaccagccgcgagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacggucgccuggcggaccgccacccugauccucgcgggggugagccugcugccggucugccaguccagcuccaugcgcaagaccgacuggcuccccauggccguggccgccaugggcgugccgccccucccgcuguucaucuucagccucaaggacacgcugaagcgccgguccuggccccugaacgagggggucauggccgugggccucgugagcauccuggcguccagccugcuccgcaacgacguccccauggccggcccccugguggccgggggccugcucaucgccugcuacgugaucaccgggaccuccgccgaccugaccgucgagaaggcggccgacaucacgugggaggaggaggccgagcagaccggcgugagccacaaccugaugaucaccguggacgacgacgggaccaugcggaucaaggacgacgagaccgagaacauccucacgguccugcugaagaccgcccuccugaucguguccggcaucuucccguacagcauccccgccacccugcucguguggcacaccuggcagaagcagacgcagcgcuccggcguccugugggacgugcccagcccgcccgagacccagaaggcggagcuggaggaggggguguaccggaucaagcagcagggcaucuucgggaagacccaggucggcgugggggugcagaaggagggcgucuuccacaccauguggcacgugacgcgcggcgccgugcucaccuacaacgggaagcggcuggagcccaacugggccuccgucaagaaggaccugaucagcuacggcgggggcuggcgccucuccacccaguggcagaagggggaggagguccaggugaucgccgucgagcccggcaagaaccccaagaacuuccagaccaugcccggcacguuccagaccaccaccggggagaucggcgcgaucgcccuggacuucaagcccgggacgagcggcagccccaucaucaaccgggagggcaaggugguggggcuguacggcaacggggucgugaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggccaucguccgcgaggcgaucaagcggcgccuccggacccugauccuggcccccacccgcgugguggccgccgagauggaggaggcccucaaggggcugcccauccgguaccagacgaccgcgaccaaguccgagcacaccggccgcgagaucgucgaccugaugugccacgccacguucaccaugcggcuccugagccccgugcgcgugccgaacuacaaccugaucaucauggacgaggcccacuucaccgaccccgccuccaucgccgcgcggggguacaucagcacccgcgucggcaugggcgaggccgccgccaucuucaugacggcgacgccgcccgggaccgccgacgccuucccgcaguccaacgcccccauccaggacgaggagcgcgacauccccgagcggagcuggaacuccggcaacgaguggaucaccgacuucgccgggaagacggugugguucgugcccagcaucaaggcgggcaacgacaucgccaacugccuccgcaagaacgggaagaaggucauccagcugucccggaagaccuucgacaccgaguaccagaagaccaagcugaacgacugggacuucguggugacgaccgacaucagcgagaugggcgccaacuucaaggccgaccgcgucaucgacccgcggcgcugccucaagcccgugauccugaccgacggccccgagcgggugauccuggccgggcccaugccggucaccgcggccuccgccgcccagcgccggggccgcguggggcggaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgcgagaaguccgccgccaucgacggcgaguaccggcugaagggcgagucccgcaagaccuucguggagcugaugcggcgcggggaccuccccgucuggcuggcgcacaagguggccagcgagggcaucaaguacaccgaccggaaguggugcuucgacgggcagcgcaacaaccagauccuggaggagaacauggacgucgagaucuggacgaaggagggcgagaagaagaagcuccggccccgcuggcuggacgcccgcaccuacuccgacccgcuggcccucaaggaguucaaggacuucgccgcgggccgcaagagcaucgcccuggaccuggugaccgagaucgggcgcgugcccucccaccucgcccaccggacccgcaacgcccuggacaaccuggucaugcuccacacgagcgagcacggcgggcgggccuaccgccacgcgguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgccagcgcgaucguccuggaguucuucaugauggugcuccugauccccgagcccgagaagcagcggacgccccaggacaaccagcuggccuacguggucaucgggauccucacccuggccgccaucaucgccgcgaacgagaugggccugcucgagaccacgaagcgcgaccugggcauguccaaggagccggggguggugagccccaccuccuaccuggacgucgaccuccaccccgccagcgccuggacccuguacgccguggcgaccacggugaucacccccaugcugcggcacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacgcugaccgccgccgugcuccugcugaucacccacuacgccaucaucggccccggccuccaggcgaaggccacccgcgaggcccagaagcggacggccgccgggaucaugaagaacccgaccgucgacggcaucaugaccaucgaccuggaccccgugaucuacgacuccaaguucgagaagcagcugggccaggugaugcuccugguccugugcgcggugcagcuccugcugaugcgcaccagcugggcccucugcgaggcccugacgcuggccaccggccccaucaccacccucugggagggcucccccgggaaguucuggaacacgaccaucgcggugagcauggccaacaucuuccggggcuccuaccuggccggggccggccuggccuucagcaucaugaaguccgucgggaccggcaagcgcggcaccgggagccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgugagccgcggcuccgccaagcugcagugguucgucgagcggaacauggugaucccggaggggcgcgugaucgaccucggcugcgggcggggcggguggagcuacuacugcgccggccugaagaaggucaccgaggugcgcggcuacacgaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccaccguggaggagagccgcacgauccggguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacccacgagauguacuggaucuccaacggcaccgggaacaucguggccagcgucaacauggugucccgccuccugcugaaccgguucacgaugacccaccgccggccgaccaucgagaaggacguggaccucggcgcgggcacccgccacgucaacgccgagcccgagacgcccaacauggacgugaucggggagcggaucaagcgcaucaaggaggagcacaacagcaccuggcacuacgacgacgagaacccguacaagaccugggccuaccacggcuccuacgaggugaaggccaccgggagcgccuccagcaugaucaacggcgucgugaagcugcugacgaagcccugggacgucgugcccauggugacccagauggcgaugaccgacaccacgcccuucgggcagcagcgggucuucaaggagaagguggacacccgcaccccgcggagcaugcccggcacccgccgggugaugggcaucacggccgaguggcucuggcgcacccuggggcggaacaagaagccccgccugugcacccgcgaggaguucaccaagaagguccggacgaacgccgccaugggcgcgguguucaccgaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaaggucgugaaggugcagcggcccacccccaccggcacggucauggacaucaucagccgcaaggaccagcggggcuccggccaggugggcaccuacgggcugaacaccuucaccaacauggaggcccagcucauccgccagauggagggcgagggggugcugagcaaggccgaccuggagaacccccaccucccggagaagaagaucacgcaguggcuggagaccaagggcgucgagcggcugaagcgcauggcgaucuccggcgacgacugcguggugaagcccaucgacgaccgguucgccaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggcgggcuggucccuccgcgagaccgccugccugggcaaggccuacgcccagauguggagccugauguacuuccaccggcgcgaccuccggcuggcguccaacgccaucugcagcgccgugcccgugcacugggucccgaccucccgcacgaccuggagcauccacgcccaccaccaguggaugaccaccgaggacaugcugacgguguggaaccggguguggaucgaggacaaccccuggauggaggacaagacccccgucaccaccugggaggacgugcccuaccucgggaagcgcgaggaccaguggugcggcagccugaucgggcugacgucccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10098 - RNA, 9873 nt, Artificial Sequence
  derived and/or modified CDS sequence (opt1) from DENV-3__KJ189286__SS-prME
accagcuucugccugaugaugauccuccccgcggcccuggcguuccaccugaccagccgggacggggagccgcggaugaucguggggaagaacgagcgcggcaagagccuccuguucaagaccgccagcgggaucaacaugugcacccugaucgccauggaccucggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccuggcgccccacgugggcauggggcucgacacccgcacccagaccuggaugagcgccgagggcgccuggcgccagguggagaaggucgagacgugggcccugcgccacccgggguucaccauccuggcccucuuccuggcccacuacaucggcaccucccugacccagaagguggugaucuucauccuccugaugcuggucacgcccagcaugaccaugcggugcgugggggugggcaaccgcgacuucgucgagggccucuccggggccaccuggguggacgugguccuggagcacggcgggugcgugaccacgauggccaagaacaagcccacccuggacaucgagcuccagaagaccgaggccacccagcuggcgacgcugcggaagcucugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccuguucgggaagggcucccucgugaccugcgccaaguuccagugccuggagcccaucgagggcaaggucgugcaguacgagaaccugaaguacaccgugaucaucacgguccacaccggggaccagcaccaggugggcaacgagacccagggggucaccgccgagaucacgccccaggccagcaccaccgaggcgacccuccccgaguacggcacccuggggcuggagugcuccccgcgcacgggccucgacuucaacgagaugauccugcugaccaugaagaacaaggccuggauggugcaccggcagugguucuucgaccucccccugcccuggaccagcggcgccaccacggagacccccaccuggaaccgcaaggagcugcucgugaccuucaagaacgcccacgccaagaagcaggaggucguggugcuggggucccaggagggcgcgaugcacacggcccugaccggggccaccgagauccagaacagcggcgggaccuccaucuucgccggccaccucaagugccggcugaagauggacaagcuggagcucaagggcaugagcuacgccaugugcacgaacaccuucguccugaagaaggagguguccgagacccagcacgggaccauccugaucaagguggaguacaagggcgaggacgcgccgugcaagauccccuucagcacggaggacgggcacggcaaggcccacaacggccgccucaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcugaacagccucggcaagaugguccaccagaucuucggguccgccuacaccgcccuguucagcggcguguccugggugaugaagaucggcaucgggguccugcucaccuggaucggccugaacagcaagaacaccuccaugagcuucuccugcaucgccaucgggaucaucacgcuguaccucggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccuggccacggccaucgccggcgcgugggagaacggggucugcggcauccgcagcaccacccggauggagaaccuccuguggaagcagaucgccaacgagcugaacuacauccucugggagaacaacaucaagcugaccgugguggucggggacaucaucggcgugcuggagcagggcaagcgcacgcucacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcugcgccuccgggaggucuacacccagcugugcgaccaccgccugaugagcgccgccgugaaggacgagcgggccgugcacgcggacaugggcuacuggaucgagagccagaagaacggguccuggaagcucgagaaggccagccugaucgaggucaagacgugcaccuggccgaagucccacacccuguggagcaacggcgugcucgaguccgacaugaucauccccaagagccuggccgggcccaucucccagcacaaccaccgcccgggcuaccacacccagacggccgggcccuggcaccugggcaagcucgagcuggacuucaacuacugcgagggcaccaccguggucaucaccgagaacugcgggacgcggggccccagccugcgcaccaccaccguguccgggaagcucauccacgaguggugcugccggagcugcacgcugcccccgcugcgcuacaugggcgaggacgggugcugguacggcauggagauccggcccaucuccgagaaggaggagaacauggugaagucccucgucuccgccggcagcgggaagguggacaacuucaccaugggcgugcugugccuggcgauccucuucgaggaggucaugcgcgggaaguucggcaagaagcacaugaucgccgggguguucuucaccuucgugcugcugcucuccggccagaucaccuggcgggacauggcccacacgcugaucaugaucggcagcaacgccuccgaccgcauggggaugggcgucaccuaccuggcccucaucgcgaccuucaagauccagcccuuccuggcccugggguucuuccuccggaagcugaccagccgcgagaaccugcuccugggcgugggccuggccauggccacgacccuccagcugcccgaggacaucgagcagauggcgaacgggaucgcccugggccucauggcccugaagcugaucacccaguucgagaccuaccagcucuggacggcccugaucagccugaccugcuccaacaccaucuucacccucacgguggccuggcggaccgcgacccugauccuggccggggucagccuccugccggugugccaguccagcuccaugcgcaagaccgacuggcugcccauggccgucgccgccaugggcgugccgccccucccgcuguucaucuucaaccugaaggacacgcucaagcgccggagcuggccccugaacgagggggugauggcggucggccugguguccauccucgccagcucccugcugcgcaacgacgugcccauggccggcccccucgucgccgggggccugcugaucgccugcuacgugaucaccgggaccagcgcggaccucaccguggagaaggccgccgacaucacgugggaggaggaggccgagcagaccggcgucucccacaaccugaugaucaccguggacgacgacgggaccaugcggaucaaggacgacgagaccgagaacauccugacggugcuccugaagaccgcccugcucaucgucagcggcaucuucccguacuccauccccgcgacccugcugguguggcacaccuggcagaagcagacgcagcgcagcggcgugcucugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgccgugcugaccuacaacgggaagcggcucgagcccaacugggccagcgugaagaaggaccugaucuccuacggcgggggcuggcgccugagcacccaguggcagaagggggaggagguccaggugaucgcgguggagcccggcaagaaccccaagaacuuccagaccaugcccggcacguuccagaccaccaccggggagaucggcgccaucgcccucgacuucaagcccgggacguccggcagccccaucaucaaccgggagggcaaggucguggggcuguacggcaacgggguggucaccaagaacggcggguacgugagcggcaucgcccagaccaacgccgagccggacggccccacccccgagcuggaggaggagauguucaagaagcgcaaccugacgaucauggaccuccaccccggguccggcaagacccggaaguaccugccggcgaucgugcgcgaggccaucaagcggcgccugcggacccucauccuggcccccacccgcgucguggccgccgagauggaggaggcgcugaaggggcuccccauccgguaccagacgaccgccaccaagagcgagcacaccggccgcgagaucguggaccugaugugccacgccacguucaccaugcggcugcucucccccguccgcgugccgaacuacaaccugaucaucauggacgaggcccacuucaccgaccccgccagcaucgcggcccggggguacaucuccacccgcgugggcaugggcgaggccgccgcgaucuucaugacggccacgccgcccgggaccgccgacgccuucccgcagagcaacgcccccauccaggacgaggagcgcgacauccccgagcgguccuggaacagcggcaacgaguggaucaccgacuucgcggggaagacggucugguucgugcccuccaucaaggccggcaacgacaucgccaacugccugcgcaagaacgggaagaaggugauccagcucagccggaagaccuucgacaccgaguaccagaagaccaagcugaacgacugggacuucgucgugacgaccgacaucuccgagaugggcgccaacuucaaggccgaccgcgugaucgacccgcggcgcugccugaagcccgucauccucaccgacggccccgagcgggugauccuggcggggcccaugccggugaccgccgccagcgccgcccagcgccggggccgcgucgggcggaacccccagaaggagaacgaccaguacaucuucaccggccagccccugaacaacgacgaggaccacgcgcacuggacggaggccaagaugcuccuggacaacaucaacacccccgaggggaucaucccggcccuguucgagcccgagcgcgagaaguccgccgcgaucgacggcgaguaccggcucaagggcgagagccgcaagaccuucguggagcugaugcggcgcggggaccugcccguguggcucgcccacaaggucgccuccgagggcaucaaguacaccgaccggaaguggugcuucgacgggcagcgcaacaaccagauccuggaggagaacauggacguggagaucuggacgaaggagggcgagaagaagaagcugcggccccgcuggcucgacgcccgcaccuacagcgacccgcuggcccugaaggaguucaaggacuucgcggccggccggaaguccaucgcccucgaccuggucaccgagaucgggcgcgugcccagccaccuggcccaccggacccgcaacgcccucgacaaccuggugaugcugcacacguccgagcacggcgggcgggcguaccgccacgccgucgaggagcuccccgagaccauggagacccugcugcuccugggccugaugauccuccugaccgggggcgccaugcuguuccucaucagcggcaaggggaucggcaagacgagcaucgggcugaucugcgugaucgccuccagcggcaugcuguggauggccgagaucccgcuccaguggaucgcguccgccaucgugcuggaguucuucaugaugguccugcucauccccgagcccgagaagcagcggacgccccaggacaaccagcuggccuacguggugaucgggauccugacccucgccgccaucaucgcggccaacgagaugggccugcuggagaccacgaagcgcgaccucggcaugagcaaggagccgggggucgugucccccaccagcuaccuggacguggaccugcaccccgccuccgccuggacccucuacgcggucgccaccacggugaucacccccaugcugcggcacaccaucgagaacagcaccgccaacgugucccuggccgccaucgcgaaccaggccgucgugcucaugggccuggacaagggguggccgaucagcaagauggaccugggcgugccccuccuggcccuggggugcuacucccaggucaacccccucacgcugaccgccgccgugcugcuccugaucacccacuacgcgaucaucggccccggccugcaggccaaggccacccgcgaggcccagaagcggacggccgcggggaucaugaagaacccgaccguggacggcaucaugaccaucgaccucgaccccgucaucuacgacagcaaguucgagaagcagcugggccaggugaugcugcucgugcugugcgccguccagcugcuccugaugcgcaccuccugggcccugugcgaggcccucacgcuggcgaccggccccaucaccacccugugggagggcagccccgggaaguucuggaacacgaccaucgccguguccauggccaacaucuuccggggcagcuaccucgccggggccggccuggcguucuccaucaugaaguccguggggaccggcaagcgcggcaccgggucccagggcgagacccugggggagaaguggaagaagaagcucaaccagcugagccggaaggaguucgaccuguacaagaaguccggcaucacggaggucgaccgcaccgaggccaaggaggggcucaagcggggcgagaucacccaccacgccgugucccgcggcagcgccaagcugcagugguucguggagcggaacauggucaucccggaggggcgcgugaucgaccugggcugcgggcggggcgggugguccuacuacugcgccggccucaagaaggugaccgagguccgcggcuacacgaagggcgggcccgggcacgaggagcccgugcccaugagcaccuacggcuggaacaucgugaagcugauguccgggaaggacgucuucuaccugccgcccgagaagugcgacacccuccugugcgacaucggcgagagcucccccagccccaccguggaggagucccgcacgauccgggugcugaagauggucgagccguggcugaagaacaaccaguucugcaucaaggugcucaaccccuacaugcccaccgugaucgagcaccuggagcgccugcagcggaagcacggcgggaugcucguccgcaacccccugagccggaacuccacccacgagauguacuggaucagcaacggcaccgggaacaucguggcguccgugaacauggucagccgccugcuccugaaccgguucacgaugacccaccgccggccgaccaucgagaaggacguggaccugggcgccggcacccgccacgugaacgccgagcccgagacgcccaacauggacgucaucggggagcggaucaagcgcaucaaggaggagcacaacuccaccuggcacuacgacgacgagaacccguacaagaccugggccuaccacggcagcuacgaggugaaggccaccggguccgcgagcuccaugaucaacggcguggucaagcuccugacgaagcccugggacgugguccccauggugacccagauggccaugaccgacaccacgcccuucgggcagcagcggguguucaaggagaaggucgacacccgcaccccgcggagcaugcccggcacccgccgggugaugggcaucacggccgaguggcuguggcgcacccucgggcggaacaagaagccccgccugugcacccgcgaggaguucaccaagaaggugcggacgaacgccgcgaugggcgccgucuucaccgaggagaaccagugggacagcgccaaggccgccguggaggacgaggacuucuggaagcugguggaccgcgagcgggagcuccacaagcuggggaagugcggcuccugcgucuacaacaugauggggaagcgcgagaagaagcugggcgaguucggcaaggcgaaggggagccgggccaucugguacauguggcucggcgcccgcuaccuggaguucgaggcccugggguuccucaacgaggaccacugguucucccgggagaacagcuacuccggcguggagggggagggccugcacaagcugggcuacauccuccgcgacaucagcaagauccccgggggcgccauguacgcggacgacaccgccgggugggacacccggaucacggaggacgaccugcacaacgaggagaagaucacccagcagauggacccggagcaccgccagcuggccaacgccaucuucaagcucaccuaccagaacaagguggucaaggugcagcggcccacccccaccggcacggugauggacaucaucucccgcaaggaccagcggggcagcgggcaggucggcaccuacgggcugaacaccuucaccaacauggaggcccagcugauccgccagauggagggcgagggggugcucuccaaggcggaccuggagaacccccaccuccccgagaagaagaucacgcaguggcuggagaccaagggcguggagcggcugaagcgcauggccaucagcggcgacgacugcgucgugaagcccaucgacgaccgguucgccaacgcccugcucgcccugaacgacauggggaaggugcgcaaggacaucccccaguggcagcccuccaagggcuggcacgacuggcagcaggucccguucugcagccaccacuuccacgagcugaucaugaaggacgggcggaagcucguggugcccugccgcccccaggacgagcugaucggccgggcgcgcaucucccagggggccggcuggagccugcgcgagaccgccugccucggcaaggccuacgcgcagauguggucccugauguacuuccaccggcgcgaccugcggcucgccagcaacgccaucugcuccgccguccccgugcacugggugccgaccagccgcacgaccugguccauccacgcccaccaccaguggaugaccaccgaggacaugcugacggucuggaaccggguguggaucgaggacaaccccuggauggaggacaagacccccgugaccaccugggaggacguccccuaccuggggaagcgcgaggaccaguggugcggcagccucaucgggcugacgagccgggcgaccugggcccagaacaucccgaccgccauccagcagguccgcucccugaucggcaacgaggaguuccucgacuacaugcccagcaugaagcgguuccgcaaggaggaggaguccgagggggccaucugguga

SEQ ID NO: 10099 - RNA, 9873 nt, Artificial Sequence
  derived and/or modified CDS sequence (opt1) from DENV-3__KJ189287__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcauccucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgugugggaggucgaggacuacggguucggcguguucaccaccaacaucuggcuccgccugcgggagguguacacccagcugugcgaccaccgccucaugagcgccgccgucaaggacgagcgggccgugcacgcggacaugggcuacuggaucgagagccagaagaacggguccuggaagcuggagaaggccagccugaucgaggugaagacgugcaccuggccgaagucccacacccucuggagcaacggcguccuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggugaucaccgagaacugcgggacgcggggccccagccuccgcaccaccaccgucuccgggaagcugauccacgaguggugcugccggagcugcacgcugcccccgcuccgcuacaugggcgaggacgggugcugguacggcauggagauccggcccaucuccgagaaggaggagaacauggucaagagccugguguccgccggcagcgggaaggucgacaacuucaccaugggcgugcugugccucgcgauccuguucgaggaggugaugcgcgggaaguucggcaagaagcacaugaucgccggggucuucuucaccuucgugcugcuccuguccggccagaucaccuggcggaacauggcccacacgcugaucaugaucggcagcaacgccuccgaccgcauggggaugggcgugaccuaccucgcccugaucgcgaccuucaagauccagcccuuccugguccucggguucuuccugcggaagcugaccagccgcgagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacgguggccuggcggaccgccacccugauccucgcgggggucagccugcugccggugugccaguccagcuccaugcgcaagaccgacuggcuccccauggccgucgccgccaugggcgugccgccccucccgcuguucaucuucagccucaaggacacgcugaagcgccgguccuggccccugaacgagggggugauggccgucggccucgugagcauccuggcguccagccugcuccgcaacgacgugcccauggccggcccccuggucgccgggggccugcucaucgccugcuacgugaucaccgggaccuccgccgaccugaccguggagaaggcggccgacaucacgugggaggaggaggccgagcagaccggcgucagccacaaccugaugaucaccguggacgacgacgggaccaugcggaucaaggacgacgagaccgagaacauccucacggugcugcugaagaccgcccuccugaucgucuccggcaucuucccguacagcauccccgccacccugcucguguggcacaccuggcagaagcagacgcagcgcuccggcgugcugugggacguccccagcccgcccgagacccagaaggcggagcuggaggaggggguguaccggaucaagcagcagggcaucuucgggaagacccaggugggcgucggggugcagaaggagggcguguuccacaccauguggcacgucacgcgcggcgccgugcucaccuacaacgggaagcggcuggagcccaacugggccuccgugaagaaggaccugaucagcuacggcgggggcuggcgccucuccacccaguggcagaagggggaggagguccaggugaucgccguggagcccggcaagaaccccaagaacuuccagaccaugcccggcacguuccagaccaccaccggggagaucggcgcgaucgcccuggacuucaagcccgggacgagcggcagccccaucaucaaccgggagggcaaggucguggggcuguacggcaacgggguggucaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggccaucgugcgcgaggcgaucaagcggcgccuccggacccugauccuggcccccacccgcgucguggccgccgagauggaggaggcccucaaggggcugcccauccgguaccagacgaccgcgaccaaguccgagcacaccggccgcgagaucguggaccugaugugccacgccacguucaccaugcggcuccugagccccguccgcgugccgaacuacaaccugaucaucauggacgaggcccacuucaccgaccccgccuccaucgccgcgcggggguacaucagcacccgcgugggcaugggcgaggccgccgccaucuucaugacggcgacgccgcccgggaccgccgacgccuucccgcaguccaacgcccccauccaggacgaggagcgcgacauccccgagcggagcuggaacuccggcaacgaguggaucaccgacuucgccgggaagacggucugguucgugcccagcaucaaggcgggcaacgacaucgccaacugccuccgcaagaacgggaagaaggugauccagcugucccggaagaccuucgacaccgaguaccagaagaccaagcugaacgacugggacuucgucgugacgaccgacaucagcgagaugggcgccaacuucaaggccgaccgcgugaucgacccgcggcgcugccucaagcccgucauccugaccgacggccccgagcgggugauccuggccgggcccaugccggugaccgcggccuccgccgcccagcgccggggccgcgucgggcggaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgcgagaaguccgccgccaucgacggcgaguaccggcugaagggcgagucccgcaagaccuucguggagcugaugcggcgcggggaccuccccguguggcuggcgcacaaggucgccagcgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacuccgacccgcuggcccucaaggaguucaaggacuucgccgcgggccgcaagagcaucgcccuggaccuggucaccgagaucgggcgcgugcccucccaccucgcccaccggacccgcaacgcccuggacaaccuggugaugcuccacacgagcgagcacggcgggcgggccuaccgccacgcggucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccacgaagcgcgaccugggcauguccaaggagccgggggucgugagccccaccuccuaccuggacguggaccuccaccccgccagcgccuggacccuguacgccgucgcgaccacggugaucacccccaugcugcggcacaccaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacgcugaccgccgccgugcuccugcugaucacccacuacgccaucaucggccccggccuccaggcgaaggccacccgcgaggcccagaagcggacggccgccgggaucaugaagaacccgaccguggacggcaucaugaccaucgaccuggaccccgucaucuacgacuccaaguucgagaagcagcugggccaggugaugcuccuggugcugugcgcgguccagcuccugcugaugcgcaccagcugggcccucugcgaggcccugacgcuggccaccggccccaucaccacccucugggagggcucccccgggaaguucuggaacacgaccaucgcggugagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucacggaggucgaccgcaccgaggcgaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccgcacgauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugucccggaacagcacccacgagauguacuggaucuccaacggcaccgggaacaucguggccagcgugaacauggucucccgccuccugcugaaccgguucacgaugacccaccgccggccgaccaucgagaaggacguggaccucggcgcgggcacccgccacgugaacgccgagcccgagacgcccaacauggacgucaucggggagcggaucaagcgcaucaaggaggagcacaacagcaccuggcacuacgacgacgagaacccguacaagaccugggccuaccacggcuccuacgaggugaaggccaccgggagcgccuccagcaugaucaacggcguggucaagcugcugacgaagcccugggacgugguccccauggugacccagauggcgaugaccgacaccacgcccuucgggcagcagcggguguucaaggagaaggucgacacccgcaccccgcggagcauggccggcacccgccgggugaugggcaucacggccgaguggcucuggcgcacccuggggcggaacaagaagccccgccugugcacccgcgaggaguucaccaagaaggugcggacgaacgccgcgaugggcgccgucuucaccgaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacaccgccgggugggacacccggaucacggaggacgaccugcacaacgaggagaagaucacccagcagauggaccccgagcaccgccagcucgccaacgccaucuucaagcugaccuaccagaacaagguggucaaggugcagcggccgacccccaccggcacggugauggacaucaucagccgcaaggaccagcggggcuccgggcaggucggcaccuacgggcugaacaccuucaccaacauggaggcccagcucauccgccagauggagggcgagggggugcugagcaaggcggaccuggagaacccccaccuccccgagaagaagaucacgcaguggcuggagaccaagggcguggagcggcugaagcgcauggccaucuccggcgacgacugcgucgugaagccgaucgacgaccgguucgccaacgcccuccuggcccugaacgacauggggaaggugcgcaaggacaucccccaguggcagcccagcaagggcuggcacgacuggcagcagguccccuucugcucccaccacuuccacgagcucaucaugaaggacgggcggaagcugguggugccgugccgcccccaggacgagcugaucggccgggcgcgcaucagccagggggccggcuggucccuccgcgagaccgccugccugggcaaggccuacgcgcagauguggagccugauguacuuccaccggcgcgaccuccggcuggccuccaacgccaucugcagcgccguccccgugcacugggugcccaccucccgcacgaccuggagcauccacgcccaccaccaguggaugaccaccgaggacaugcugacggucuggaaccggguguggaucgaggacaacccguggauggaggacaagacccccgugaccaccugggaggacguccccuaccucgggaagcgcgaggaccaguggugcggcagccugaucgggcugacgucccgggcgaccugggcccagaacauccccaccgccauccagcagguccgcagccucaucggcaacgaggaguuccuggacuacaugccguccaugaagcgguuccgcaaggaggaggagagcgagggggccaucugguga

SEQ ID NO: 10100 - RNA, 9873 nt, Artificial Sequence
  derived and/or modified CDS sequence (opt1) from DENV-3__KJ189288__SS-prME
accagccucugccucaugaugauccugcccgccgcccuggcguuccaccucaccagccgggacggcgagccccggaugaucguggggaagaacgagcgcggcaagagccugcuguucaagaccgccuccgggaccaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagacguggaugagcgccgagggcgccuggcggcaggucgagaaggucgagaccugggcccugcgccacccgggguucaccauccucgcgcuguuccuggcccacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggcgacccuccggaagcugugcaucgagggcaagaucaccaacaucaccacggacagccgcugccccacccagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaagaugguccaguacgagaaccucaaguacacggugaucaucaccgugcacaccggggaccagcaccaggucggcaacgagacccagggggugacggccgagaucacgccccaggccagcaccaccgaggcgacccugcccgaguacggcacgcuggggcucgagugcuccccgcgcaccggccuggacuucaacgagaugauccugcucaccaugaagaacaaggccuggaugguccaccggcagugguucuucgaccugccccugcccuggaccagcggcgccacgaccgagacccccaccuggaaccgcaaggagcuccuggugacguucaagaacgcccacgccaagaagcaggagguggucgugcuggggucccaggagggcgcgaugcacaccgcccucaccggggccaccgagauccagaacagcggcgggacguccaucuucgccggccaccugaagugccggcugaagauggacaagcucgagcugaagggcaugagcuacgccaugugcaccaacaccuucgugcugaagaaggaggucuccgagacccagcacgggacgauccucaucaagguggaguacaagggcgaggacgcgccgugcaagauccccuucagcaccgaggacgggcacggcaaggcccacaacggccgccugaucaccgccaaccccguggucaccaagaaggaggagcccgugaacaucgaggccgagccgcccuucggggagagcaacaucgugaucggcaucggggacaacgcgcugaagaucaacugguacaagaagggcuccagcaucgggaagauguucgaggccacggcccggggcgcccgccggauggccauccugggcgacaccgcgugggacuucggguccgucggcggggugcucaacagccugggcaagauggugcaccagaucuucggguccgccuacaccgcccuguucagcggcgucuccugggugaugaagaucggcaucggggugcuccugaccuggaucggccugaacagcaagaacacguccaugagcuucuccugcaucgccaucgggaucaucacccucuaccugggcgccgucgugcaggcggacauggggugcgugaucaacuggaagggcaaggagcugaagugcggcagcgggaucuucgucaccaacgaggugcacaccuggacggagcaguacaaguuccaggccgacucccccaagcgccucgccaccgccaucgccggcgcgugggagaacggggugugcggcauccgcagcaccacccggauggagaaccugcuguggaagcagaucgccaacgagcucaacuacauccugugggagaacaacgucaagcugacggugguggucggggacaucaucggcgugcucgagcagggcaagcgcacccugacgccccagccgauggagcugaaguacuccuggaagaccugggggaaggccaagaucgugacggccgagacccagaacagcuccuucaucaucgacggccccaacacccccgagugccccagcgcgucccgggccuggaacgucugggagguggaggacuacggguucggcguguucaccaccaacaucuggcuccgccugcgggaggccuacacgcagcugugcgaccaccgccucaugagcgccgccgucaaggacgagcgggcggugcacgccgacaugggcuacuggaucgagagccagaagaacggguccuggaagcuggagaaggccagccugaucgaggugaagaccugcaccuggccgaagucccacacccucuggagcaacggcguccuggaguccgacaugaucauccccaagagccuggccgggcccaucucccagcacaaccaccgcccgggcuaccacacgcagaccgccgggcccuggcaccucggcaagcuggagcuggacuucaacuacugcgagggcaccaccguggugaucacggagaacugcgggacccggggccccagccuccgcaccaccacggucuccgggaagcugauccacgaguggugcugccggagcugcacccugcccccgcuccgcuacaugggcgaggacgggugcugguacggcauggagauccggcccaucuccgagaaggaggagaacauggucaagagccugguguccgcgggcagcgggaaggucgacaacuucaccaugggcgugcugugccucgccauccuguucgaggaggugaugcgcgggaaguucggcaagaagcacaugaucgccggggucuucuucaccuucgugcugcuccuguccggccagaucacguggcgggacauggcccacacccugaucaugaucggcagcaacgccuccgaccgcauggggaugggcgugaccuaccucgcgcugaucgccaccuucaagauccagcccuuccuggcccucggguucuuccugcggaagcugacgagccgcgagaaccuccugcugggcgucggccucgccauggcgaccacccugcagcugcccgaggacaucgagcagauggccaacgggaucgcccucggccugauggcccugaagcucaucacccaguucgagacguaccagcuguggaccgcccugaucagccugaccugcuccaacaccaucuucacgcugaccguggcguggcggaccgccacccugauccucgccggggugagccugcugccggucugccaguccagcuccaugcgcaagacggacuggcuccccauggccguggccgcgaugggcgugccgccccucccgcuguucaucuucagccucaaggacacccugaagcgccgguccuggccccugaacgagggggugauggccgugggccucgucagcauccuggccuccagccugcuccgcaacgacgugcccauggccggcccccugguggccgggggccugcucaucgcgugcuacgucaucaccgggaccuccgccgaccugacgguggagaaggccgccgacaucaccugggaggaggaggccgagcagaccggcgugagccacaaccugaugaucaccgucgacgacgacgggaccaugcggaucaaggacgacgagacggagaacauccucaccgugcugcugaagaccgcgcuccugaucguguccggcaucuucccguacagcauccccgccacccugcucgucuggcacacguggcagaagcagacccagcgcuccggcgugcugugggacgugcccagcccgcccgagacccagaaggccgagcuggaggagggggucuaccggaucaagcagcagggcaucuucgggaagacccaggugggcguggggguccagaaggagggcguguuccacacgauguggcacgugacccgcggcgccguccucaccuacaacgggaagcggcuggagcccaacugggcguccgugaagaaggaccugaucagcuacggcgggggcuggcgccucuccacccaguggcagaagggggaggaggugcaggucaucgccguggagcccggcaagaaccccaagaacuuccagacgaugcccggcaccuuccagaccaccacgggggagaucggcgccaucgcccuggacuucaagcccgggaccagcggcagccccaucaucaaccgggagggcaagguggucgggcuguacggcaacgggguggugaccaagaacggcggguacgucuccggcaucgcccagaccaacgcggagccggacggccccacgcccgagcuggaggaggagauguucaagaagcgcaaccucaccaucauggaccugcaccccgggagcggcaagacccggaaguaccugccggccaucgugcgcgaggccaucaagcggcgccuccggacccugauccuggcccccacgcgcguggucgccgcggagauggaggaggcccucaaggggcugcccauccgguaccagaccaccgccaccaaguccgagcacacgggccgcgagaucguggaccugaugugccacgccaccuucaccaugcggcuccugagccccgugcgcgucccgaacuacaaccugaucaucauggacgaggcccacuucaccgaccccgcguccaucgccgcccggggguacaucagcacgcgcgugggcaugggcgaggccgcggccaucuucaugaccgccacgccgcccgggaccgccgacgccuucccgcaguccaacgcgcccauccaggacgaggagcgcgacauccccgagcggagcuggaacuccggcaacgaguggaucacggacuucgccgggaagaccgugugguucguccccagcaucaaggccggcaacgacaucgccaacugccuccgcaagaacgggaagaaggugauccagcugucccggaagaccuucgacaccgaguaccagaagacgaagcugaacgacugggacuucguggucaccaccgacaucagcgagaugggcgccaacuucaaggcggaccgcgugaucgacccgcggcgcugccucaagcccgugauccugaccgacggccccgagcgggucauccuggccgggcccaugccggugaccgccgccuccgccgcgcagcgccggggccgcguggggcggaacccccagaaggagaacgaccaguacaucuucacgggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagucccgcaagaccuucgucgagcugaugcggcgcggggaccuccccguguggcuggcccacaagguggccagcgagggcaucaaguacacggaccggaaguggugcuucgacgggcagcgcaacaaccagauccuggaggagaacauggacgucgagaucuggaccaaggagggcgagaagaagaagcuccggccccgcuggcuggacgcccgcaccuacuccgacccgcuggcgcucaaggaguucaaggacuucgccgccggccgcaagagcaucgcccuggaccuggugaccgagaucgggcgcguccccucccaccucgcccaccggacgcgcaacgcgcuggacaaccuggugaugcuccacaccagcgagcacggcgggcgggccuaccgccacgccguggaggagcugcccgagaccauggagacccugcuccugcugggccucaugauccugcugaccggcggggccaugcuguuccugaucagcgggaaggggaucggcaagaccuccaucgggcugaucugcgucaucgccagcuccggcaugcucuggauggcggagaucccgcugcaguggaucgccagcgccaucgugcuggaguucuucaugauggugcuccugguccccgagcccgagaagcagcggacgccccaggacaaccagcuggccuacguggugaucgggauccucacccuggccgcgaucaucgccgccaacgagaugggccugcucgagacgaccaagcgcgaccugggcauguccaaggagccgggggucgugagccccaccuccuaccuggacguggaccuccaccccgccagcgcguggacccuguacgccgucgccacgaccgugaucacccccaugcugcggcacaccaucgagaacuccacggccaacgugagccucgccgcgaucgccaaccaggccgucgugcugaugggccuggacaagggguggccgaucuccaagauggaccucggcgugccccugcuggcccucgggugcuacagccaggucaacccccugacccugaccgccgcggugcuccugcugaucacccacuacgccaucaucggccccggccuccaggccaaggccacgcgcgaggcccagaagcggaccgcggccgggaucaugaagaacccgaccguggacggcaucaugaccaucgaccuggaccccgucaucuacgacuccaaguucgagaagcagcugggccaggugaugcuccuggugcugugcgccguccagcuccugcugaugcgcacgagcugggcccucugcgaggcgcugacccuggccaccggccccaucaccacgcucugggagggcucccccgggaaguucuggaacaccaccaucgccgugagcauggccaacaucuuccggggcuccuaccuggccggggcgggccuggccuucagcaucaugaaguccguggggaccggcaagcgcggcaccgggagccagggcgagacgcucggggagaaguggaagaagaagcugaaccagcugagccggaaggaguucgaccucuacaagaaguccggcaucaccgaggucgaccgcaccgaggccaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgcgggccugaagaaggugacggagguccgcggcuacaccaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccacgguggaggagagccgcaccauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugucccggaacagcacccacgagauguacuggaucuccaacggcacggggaacaucguggccagcgugaacauggucucccgccuccugcugaaccgguucaccaugacccaccgccggccgaccaucgagaaggacguggaccucggcgccggcacgcgccacgugaacgccgagcccgagacccccaacauggacgucaucggggagcggaucaagcgcaucaaggaggagcacaacagcaccuggcacuacgacgacgagaacccguacaagaccugggccuaccacggcuccuacgaggugaaggcgacggggagcgccuccagcaugaucaacggcguggucaagcugcugaccaagcccugggacgugguccccauggugacccagauggccaugaccgacacgacccccuucgggcagcagcggguguucaaggagaaggucgacacccgcaccccgcggagcaugcccggcacgcgccgggugaugggcaucaccgccgaguggcucuggcgcacccuggggcggaacaagaagccccgccugugcacccgcgaggaguucacgaagaaggugcggaccaacgcggccaugggcgccgucuucaccgaggagaaccagugggacuccgccaaggccgcgguggaggacgaggacuucuggaagcucguggaccgcgagcgggagcugcacaagcuggggaagugcggcagcugcgucuacaacaugauggggaagcgcgagaagaagcucggcgaguucggcaaggccaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgcgauguacgccgacgacaccgccgggugggacacgcggaucaccgaggacgaccugcacaacgaggagaagaucacccagcagauggacccggagcaccgccagcucgccaacgccaucuucaagcugaccuaccagaacaagguggucaaggugcagcggcccacccccacgggcaccgugauggacaucaucagccgcaaggaccagcggggcuccgggcaggucggcaccuacgggcugaacaccuucacgaacauggaggcgcagcucauccgccagauggagggcgagggggugcugagcaaggccgaccuggagaacccccaccucccggagaagaagaucacccaguggcuggagaccaagggcguggagcggcugaagcgcauggccaucuccggcgacgacugcgucgugaagcccaucgacgaccgguucgccaacgcccuccuggcgcugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggccggcuggucccuccgcgagaccgccugccugggcaaggcguacgcccagauguggagccugauguacuuccaccggcgcgaccuccggcuggccuccaacgccaucugcagcgccguccccgugcacugggugccgacgucccgcaccaccuggagcauccacgcgcaccaccaguggaugaccacggaggacaugcugaccgucuggaaccggguguggaucgaggacaaccccuggauggaggacaagacccccgugaccacgugggaggacguccccuaccucgggaagcgcgaggaccaguggugcggcagccugaucgggcugaccucccgggccaccugggcccagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10101 - RNA, 9873 nt, Artificial Sequence
  derived and/or modified CDS sequence (opt1) from DENV-3__KJ189289__SS-prME
accagccucugccucaugaugauccugcccgccgcccuggcguuccaccucaccagccgggacggcgagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcggagcguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacacgaucggcgugcucgagcagggcaagcgcacccugacgccccagccgauggagcugaaguacuccuggaagaccugggggaaggccaagaucgugacggccgagacccagaacagcuccuucaucaucgacggccccaacacccccgagugccccagcgcgucccgggccuggaacgucugggagguggaggacuacggguucggcguguucaccaccaacaucuggcuccgccugcgggaggucuacacgcagcugugcgaccaccgccucaugagcgccgccgugaaggacgagcgggccgugcacgcggacaugggcuacuggaucgagagccagaagaacggguccuggaagcuggagaaggccagccugaucgaggucaagaccugcaccuggccgaagucccacacccucuggagcaacggcgugcuggaguccgacaugaucauccccaagagccuggccgggcccaucucccagcacaaccaccgcccgggcuaccacacgcagaccgccgggcccuggcaccucggcaagcuggagcuggacuucaacuacugcgagggcaccaccguggucaucacggagaacugcgggacccggggccccagccuccgcaccaccacgguguccgggaagcugauccacgaguggugcugccggagcugcacccugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgcgauccuguucgaggaggucaugcgcgggaaguucggcaagaagcacaugaucgccgggguguucuucaccuucgugcugcuccuguccggccagaucacguggcgggacauggcccacacccugaucaugaucggcagcaacgccuccgaccgcauggggaugggcgucaccuaccucgcccugaucgcgaccuucaagauccagcccuuccuggcccucggguucuuccugcggaagcugacgagccgcgagaaccuccugcugggcgugggccucgccauggccaccacccugcagcugcccgaggacaucgagcagauggcgaacgggaucgcccucggccugauggcccugaagcucaucacccaguucgagacguaccagcuguggaccgcccugaucagccugaccugcuccaacaccaucuucacgcugaccguggccuggcggaccgcgacccugauccucgccggggucagccugcugccggugugccaguccagcuccaugcgcaagacggacuggcuccccauggccgucgccgccaugggcgugccgccccucccgcuguucaucuucagccucaaggacacccugaagcgccgguccuggccccugaacgagggggugauggcggucggccucgugagcauccuggccuccagccugcuccgcaacgacgugcccauggccggcccccuggucgccgggggccugcucaucgccugcuacgugaucaccgggaccuccgcggaccugacgguggagaaggccgccgacaucaccugggaggaggaggccgagcagaccggcgucagccacaaccugaugaucaccguggacgacgacgggaccaugcggaucaaggacgacgagacggagaacauccucaccgugcugcugaagaccgcccuccugaucgucuccggcaucuucccguacagcauccccgcgacccugcucguguggcacacguggcagaagcagacccagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacacgauguggcacgucacccgcggcgccgugcucaccuacaacgggaagcggcuggagcccaacugggccuccgugaagaaggaccugaucagcuacggcgggggcuggcgccucuccacccaguggcagaagggggaggagguccaggugaucgcgguggagcccggcaagaaccccaagaacuuccagacgaugcccggcaccuuccagaccaccacgggggagaucggcgccaucgcccuggacuucaagcccgggaccagcggcagccccaucaucaaccgggagggcaaggucguggggcuguacggcaacgggguggucaccaagaacggcggguacguguccggcaucgcccagaccaacgccgagccggacggccccacgcccgagcuggaggaggagauguucaagaagcgcaaccucaccaucauggaccugcaccccgggagcggcaagacccggaaguaccugccggcgaucgugcgcgaggccaucaagcggcgccuccggacccugauccuggcccccacgcgcgucguggccgccgagauggaggaggcgcucaaggggcugcccauccgguaccagaccaccgccaccaaguccgagcacacgggccgcgagaucguggaccugaugugccacgccaccuucaccaugcggcuccugagccccguccgcgugccgaacuacaaccugaucaucauggacgaggcccacuucaccgaccccgccuccaucgcggcccggggguacaucagcacgcgcgugggcaugggcgaggccgccgcgaucuucaugaccgccacgccgcccgggaccgccgacgccuucccgcaguccaacgcccccauccaggacgaggagcgcgacauccccgagcggagcuggaacuccggcaacgaguggaucacggacuucgcggggaagaccgucugguucgugcccagcaucaaggccggcaacgacaucgccaacugccuccgcaagaacgggaagaaggugauccagcugucccggaagaccuucgacaccgaguaccagaagacgaagcugaacgacugggacuucgucgugaccaccgacaucagcgagaugggcgccaacuucaaggccgaccgcgugaucgacccgcggcgcugccucaagcccgucauccugaccgacggccccgagcgggugauccuggcggggcccaugccggugaccgccgccuccgccgcccagcgccggggccgcgucgggcggaacccccagaaggagaacgaccaguacaucuucacgggccagccccucaacaacgacgaggaccacgcgcacuggaccgaggccaagaugcugcuggacaacaucaacacccccgaggggaucaucccggcccucuucgagcccgagcgcgagaaguccgccgcgaucgacggcgaguaccggcugaagggcgagucccgcaagaccuucguggagcugaugcggcgcggggaccuccccguguggcuggcccacaaggucgccagcgagggcaucaaguacacggaccggaaguggugcuucgacgggcagcgcaacaaccagauccuggaggagaacauggacguggagaucuggaccaaggagggcgagaagaagaagcuccggccccgcuggcuggacgcccgcaccuacuccgacccgcuggcccucaaggaguucaaggacuucgcggccggccgcaagagcaucgcccuggaccuggucaccgagaucgggcgcgugcccucccaccucgcccaccggacgcgcaacgcccuggacaaccuggugaugcuccacaccagcgagcacggcgggcgggcguaccgccacgccgucgaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugcucuggauggccgagaucccgcugcaguggaucgcgagcgccaucgugcuggaguucuucaugaugguccuccugauccccgagcccgagaagcagcggacgccccaggacaaccagcuggccuacguggugaucgggauccucacccuggccgccaucaucgcggccaacgagaugggccugcucgagacgaccaagcgcgaccugggcauguccaaggagccgggggucgugagcuccaccagcuaccuggacguggaccuccaccccgccuccgccuggacccuguacgcggucgccacgaccgugaucacccccaugcugcggcacaccaucgagaacagcacggccaacgugucccucgccgccaucgcgaaccaggccgucgugcugaugggccuggacaagggguggcccaucagcaagauggaccucggcgugccgcugcuggcccucgggugcuacucccaggucaacccccugacccugaccgccgccgugcuccugcugaucacccacuacgcgaucaucggccccggccuccaggccaaggccacgcgcgaggcccagaagcggaccgccgcggggaucaugaagaaccccaccguggacggcaucaugaccaucgaccuggacccggucaucuacgacagcaaguucgagaagcagcugggccaggugaugcuccuggugcugugcgccguccagcuccugcugaugcgcacguccugggcccucugcgaggcccugacccuggcgaccggccccaucaccacgcucugggagggcagccccgggaaguucuggaacaccaccaucgccguguccauggccaacaucuuccggggcagcuaccuggccggggccggccuggcguucuccaucaugaaguccguggggaccggcaagcgcggcaccgggagccagggcgagacgcucggggagaaguggaagaagaagcugaaccagcugucccggaaggaguucgaccucuacaagaaguccggcaucaccgaggucgaccgcaccgaggccaaggaggggcugaagcggggcgagaucacccaccacgccgugucccgcggcagcgccaagcugcagugguucguggagcggaacauggucauccccgaggggcgcgugaucgaccucggcugcgggcggggcgggugguccuacuacugcgccggccugaagaaggugacggagguccgcggcuacaccaagggcgggccggggcacgaggagcccgugcccaugagcaccuacggcuggaacaucgugaagcugauguccgggaaggacgucuucuaccucccgcccgagaagugcgacacccugcugugcgacaucggcgagagcucccccagccccacgguggaggagucccgcaccauccgggugcugaagauggucgagcccuggcucaagaacaaccaguucugcaucaaggugcugaaccccuacaugcccaccgugaucgagcaccuggagcgccuccagcggaagcacggcgggaugcugguccgcaacccccugagccggaacuccacccacgagauguacuggaucagcaacggcacggggaacaucguggcguccgugaacauggucagccgccuccugcugaaccgguucaccaugacccaccgccggcccaccaucgagaaggacguggaccucggcgccggcacgcgccacgugaacgccgagccggagacccccaacauggacgucaucggggagcggaucaagcgcaucaaggaggagcacaacuccaccuggcacuacgacgacgagaaccccuacaagaccugggccuaccacggcagcuacgaggugaaggccacgggguccgcgagcagcaugaucaacggcguggucaagcugcugaccaagccgugggacgugguccccauggugacccagauggccaugaccgacacgacccccuucgggcagcagcggguguucaaggagaaggucgacacccgcacgccccgguccaugccgggcacgcgccgggugaugggcaucaccgccgaguggcucuggcgcacccuggggcggaacaagaagccccgccugugcacccgcgaggaguucacgaagaaggugcggaccaacgccgcgaugggcgccgucuucaccgaggagaaccagugggacagcgccaagaccgccguggaggacgaggacuucuggaagcucguggaccgcgagcgggagcugcacaagcuggggaagugcggcuccugcgucuacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacacggcggggugggacacccggaucaccgaggacgaccugcacaacgaggagaagaucacccagcagauggaccccgagcaccgccagcucgccaacgccaucuucaagcugaccuaccagaacaagguggucaaggugcagcggccgacgcccaccggcaccgugauggacaucaucucccgcaaggaccagcggggcagcgggcaggucggcaccuacgggcugaacacguucaccaacauggaggcccagcucauccgccagauggagggcgagggggugcuguccaaggccgaccuggagaacccccaccuccccgagaagaagaucacccaguggcuggagaccaagggcguggagcggcugaagcgcauggcgaucagcggcgacgacugcgucgugaagccgaucgacgaccgguucgccaacgcccuccuggcccugaacgacauggggaaggugcgcaaggacaucccccaguggcagcccuccaagggcuggcacgacuggcagcagguccccuucugcagccaccacuuccacgagcucaucaugaaggacgggcggaagcugguggugccgugccgcccccaggacgagcugaucggccgggcccgcaucucccagggggcgggcuggagccuccgcgagacggccugccugggcaaggccuacgcccagauguggucccugauguacuuccaccggcgcgaccuccggcuggcgagcaacgccaucugcuccgccguccccgugcacugggugcccaccagccgcaccaccuggagcauccacgcccaccaccaguggaugacgaccgaggacaugcugaccgucuggaaccggguguggaucgaggacaacccguggauggaggacaagacccccgugacgaccugggaggacguccccuaccucgggaagcgcgaggaccaguggugcggcucccugaucgggcugaccagccgggccaccugggcgcagaacauccccacggccauccagcagguccgcucccucaucggcaacgaggaguuccuggacuacaugccgagcaugaagcgguuccgcaaggaggaggaguccgagggggccaucugguga

SEQ ID NO: 10102 - RNA, 9873 nt, Artificial Sequence
  derived and/or modified CDS sequence (opt1) from DENV-3__KJ189290__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcuccgccugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggucaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgcgauccuguucgaggaggucaugcgcgggaaguucggcaagaagcacaugaucgccgggguguucuucaccuucgugcugcuccuguccggccagaucaccuggcggaacauggcccacacgcugaucaugaucggcagcaacgccuccgaccgcauggggaugggcgucaccuaccucgcccugaucgcgaccuucaagauccagcccuuccuggcccucggguucuuccugcggaagcugaccagccgcgagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccaucuucacccugacgguggccuggcggaccgcgacccugauccucgccggggucagccugcugccggugugccaguccagcuccaugcgcaagaccgacuggcuccccauggccgucgccgccaugggcgugccgccccucccgcuguucaucuucagccucaaggacacgcugaagcgccgguccuggccccugaacgagggggugauggcggucggccucgugagcauccuggccuccagccugcuccgcaacgacgugcccauggccggcccccuggucgccgggggccugcucaucgccugcuacgugaucaccgggaccuccgcggaccugaccguggagaaggccgccgacaucacgugggaggaggaggccgagcagaccggcgucagccacaaccugaugaucaccguggacgacgacgggaccaugcggaucaaggacgacgagaccgagaacauccucacggugcugcugaagaccgcccuccugaucgucuccggcaucuucccguacagcauccccgcgacccugcucguguggcacaccuggcagaagcagacgcagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgccgugcucaccuacaacgggaagcggcuggagcccaacugggccuccgugaagaaggaccugaucagcuacggcgggggcuggcgccucuccacccaguggcagaagggggaggagguccaggugaucgcgguggagcccggcaagaaccccaagaacuuccagaccaugcccggcacguuccagaccaccaccggggagaucggcgccaucgcccuggacuucaagcccgggacgagcggcagccccaucaucaaccgggagggcaaggucguggggcuguacggcaacgggguggucaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggcgaucgugcgcgaggccaucaagcggcgccuccggacccugauccuggcccccacccgcgucguggccgccgagauggaggaggcgcucaaggggcugcccauccgguaccagacgaccgccaccaaguccgagcacaccggccgcgagaucguggaccugaugugccacgccacguucaccaugcggcuccugagccccguccgcgugccgaacuacaaccugaucaucauggacgaggcccacuucaccgaccccgccuccaucgcggcccggggguacaucagcacccgcgugggcaugggcgaggccgccgcgaucuucaugacggccacgccgcccgggaccgccgacgccuucccgcaguccaacgcccccauccaggacgaggagcgcgacauccccgagcggagcuggaacuccggcaacgaguggaucaccgacuucgcggggaagacggucugguucgugcccagcaucaaggccggcaacgacaucgccaacugccuccgcaagaacgggaagaaggugauccagcugucccggaagaccuucgacaccgaguaccagaagaccaagcugaacgacugggacuucgucgugacgaccgacaucagcgagaugggcgccaacuucaaggccgaccgcgugaucgacccgcggcgcugccucaagcccgucauccugaccgacggccccgagcgggugauccuggcggggcccaugccggugaccgccgccuccgccgcccagcgccggggccgcgucgggcggaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgcgagaaguccgccgcgaucgacggcgaguaccggcugaagggcgagucccgcaagaccuucguggagcugaugcggcgcggggaccuccccguguggcuggcccacaaggucgccagcgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacuccgacccgcuggcccucaaggaguucaaggacuucgcggccggccgcaagagcaucgcccuggaccuggucaccgagaucgggcgcgugcccucccaccucgcccaccggacccgcaacgcccuggacaaccuggugaugcuccacacgagcgagcacggcgggcgggcguaccgccacgccgucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucgugcuggaguucuucaugaugguccuccugauccccgagcccgagaagcagcggacgccccaggacaaccagcuggccuacguggugaucgggauccucacccuggccgccaucaucgcggccaacgagaugggccugcucgagaccacgaagcgcgaccugggcauguccaaggagccgggggucgugagccccaccuccuaccuggacguggaccuccaccccgccagcgccuggacccuguacgcggucgccaccacggugaucacccccaugcugcggcacaccaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacgcugaccgccgccgugcuccugcugaucacccacuacgcgaucaucggccccggccuccaggccaaggccacccgcgaggcccagaagcggacggccgcggggaucaugaagaacccgaccguggacggcaucaugaccaucgaccuggaccccgucaucuacgacuccaaguucgagaagcagcugggccaggugaugcuccuggugcugugcgccguccagcuccugcugaugcgcaccagcugggcccucugcgaggcccugacgcuggcgaccggccccaucaccacccucugggagggcucccccgggaaguucuggaacacgaccaucgccgugagcauggccaacaucuuccggggcuccuaccuggccggggccggccuggcguucagcaucaugaaguccguggggaccggcaagcgcggcaccgggagccagggcgagacccucggggagaaguggaagaagaagcugaaccagcugagccggaaggaguucgaccucuacaagcgcuccggcaucacggaggucgaccggaccgaggccaaggaggggcugaagcgcggcgagaucacccaccacgccgugagccggggcuccgccaagcugcagugguucguggagcgcaacauggucaucccggaggggcgggugaucgaccucggcugcgggcgcggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccggacgauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugucccgcaacagcacccacgagauguacuggaucuccaacggcaccgggaacaucguggcgagcgugaacauggucucccggcuccugcugaaccgcuucacgaugacccaccggcgcccgaccaucgagaaggacguggaccucggcgccggcacccggcacgugaacgccgagcccgagacgcccaacauggacgucaucggggagcgcaucaagcggaucaaggaggagcacaacagcaccuggcacuacgacgaggagaacccguacaagaccugggccuaccacggcuccuacgaggugaaggccaccgggagcgcguccagcaugaucaacggcguggucaagcugcugacgaagcccugggacgugguccccauggugacccagauggccaugaccgacaccacgcccuucgggcagcagcgcguguucaaggagaaggucgacacccggaccccgcgcagcaugcccggcacccggcgcgugaugggcaucacggccgaguggcucuggcggacccuggggcgcaacaagaagccccgccugugcacccgggaggaguucaccaagaaggugcgcacgaacgccgcgaugggcgccgucuucaccgaggagaaccagugggacuccgccaaggccgccguggaggacgaggacuucuggaagcucguggaccgggagcgcgagcugcacaagcuggggaagugcggcagcugcgucuacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgcggacgacaccgccgggugggacacccgcaucacggaggacgaccugcacaacgaggagaagaucacccagcagauggacccggagcaccggcagcucgccaacgccaucuucaagcugaccuaccagaacaagguggucaaggugcagcgccccacccccaccggcacggugauggacaucaucagccggaaggaccagcgcggcuccgggcaggucggcaccuacgggcugaacaccuucaccaacauggaggcccagcucauccggcagauggagggcgagggggugcugagcaaggcggaccuggagaacccccaccucccggagaagaagaucacgcaguggcuggagaccaagggcguggagcgccugaagcggauggccaucuccggcgacgacugcgucgugaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcgcgcaucagccagggggccggcuggucccuccgggagaccgccugccugggcaaggccuacgcgcagauguggagccugauguacuuccaccgccgggaccuccgccuggccuccaacgccaucugcagcgccguccccgugcacugggugccgaccucccggacgaccuggagcauccacgcccaccaccaguggaugaccaccgaggacaugcugacggucuggaaccgcguguggaucgaggacaaccccuggauggaggacaagacccccgugaccaccugggaggacguccccuaccucgggaagcgggaggaccaguggugcggcagccugaucgggcugacgucccgcgcgaccugggcccagaacaucccgaccgccauccagcagguccggagccucaucggcaacgaggaguuccuggacuacaugcccuccaugaagcgcuuccggaaggaggaggagagcgagggggccaucugguga

SEQ ID NO: 10103 - RNA, 9873 nt, Artificial Sequence
  derived and/or modified CDS sequence (opt1) from DENV-3__KJ189291__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcuccgccugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggucaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgcgauccuguucgaggaggucaugcgcgggaaguucggcaagaagcacaugaucgccgggguguucuucaccuucgugcugcuccuguccggccagaucaccuggcggaacauggcccacacgcugaucaugaucggcagcaacgccuccgaccgcauggggaugggcgucaccuaccucgcccugaucgcgaccuucaagauccagcccuuccuggcccucggguucuuccugcggaagcugaccagccgcgagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccaucuucacccugacgguggccuggcggaccgcgacccugauccucgccggggucagccugcugccggugugccaguccagcuccaugcgcaagaccgacuggcuccccauggccgucgccgccaugggcgugccgccccucccgcuguucaucuucagccucaaggacacgcugaagcgccgguccuggccccugaacgagggggugauggcggucggccucgugagcauccuggccuccagccugcuccgcaacgacgugcccauggccggcccccuggucgccgggggccugcucaucgccugcuacgugaucaccgggaccuccgcggaccugaccguggagaaggccgccgacaucacgugggaggaggaggccgagcagaccggcgucagccacaaccugaugaucaccguggacgacgacgggaccaugcggaucaaggacgacgagaccgagaacauccucacggugcugcugaagaccgcccuccugaucgucuccggcaucuucccguacagcauccccgcgacccugcucguguggcacaccuggcagaagcagacgcagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgccgugcucaccuacaacgggaagcggcuggagcccaacugggccuccgugaagaaggaccugaucagcuacggcgggggcuggcgccucuccacccaguggcagaagggggaggagguccaggugaucgcgguggagcccggcaagaaccccaagaacuuccagaccaugcccggcacguuccagaccaccaccggggagaucggcgccaucgcccuggacuucaagcccgggacgagcggcagccccaucaucaaccgggagggcaaggucguggggcuguacggcaacgggguggucaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggcgaucgugcgcgaggccaucaagcggcgccuccggacccugauccuggcccccacccgcgucguggccgccgagauggaggaggcgcucaaggggcugcccauccgguaccagacgaccgccaccaaguccgagcacaccggccgcgagaucguggaccugaugugccacgccacguucaccaugcggcuccugagccccguccgcgugccgaacuacaaccugaucaucauggacgaggcccacuucaccgaccccgccuccaucgcggcccggggguacaucagcacccgcgugggcaugggcgaggccgccgcgaucuucaugacggccacgccgcccgggaccgccgacgccuucccgcaguccaacgcccccauccaggacgaggagcgcgacauccccgagcggagcuggaacuccggcaacgaguggaucaccgacuucgcggggaagacggucugguucgugcccagcaucaaggccggcaacgacaucgccaacugccuccgcaagaacgggaagaaggugauccagcugucccggaagaccuucgacaccgaguaccagaagaccaagcugaacgacugggacuucgucgugacgaccgacaucagcgagaugggcgccaacuucaaggccgaccgcgugaucgacccgcggcgcugccucaagcccgucauccugaccgacggccccgagcgggugauccuggcggggcccaugccggugaccgccgccuccgccgcccagcgccggggccgcgucgggcggaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgcgagaaguccgccgcgaucgacggcgaguaccggcugaagggcgagucccgcaagaccuucguggagcugaugcggcgcggggaccuccccguguggcuggcccacaaggucgccagcgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacuccgacccgcuggcccucaaggaguucaaggacuucgcggccggccgcaagagcaucgcccuggaccuggucaccgagaucgggcgcgugcccucccaccucgcccaccggacccgcaacgcccuggacaaccuggugaugcuccacacgagcgagcacggcgggcgggcguaccgccacgccgucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucgugcuggaguucuucaugaugguccuccugauccccgagcccgagaagcagcggacgccccaggacaaccagcuggccuacguggugaucgggauccucacccuggccgccaucaucgcggccaacgagaugggccugcucgagaccacgaagcgcgaccugggcauguccaaggagccgggggucgugagccccaccuccuaccuggacguggaccuccaccccgccagcgccuggacccuguacgcggucgccaccacggugaucacccccaugcugcggcacaccaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacgcugaccgccgccgugcuccugcugaucacccacuacgcgaucaucggccccggccuccaggccaaggccacccgcgaggcccagaagcggacggccgcggggaucaugaagaacccgaccguggacggcaucaugaccaucgaccuggaccccgucaucuacgacuccaaguucgagaagcagcugggccaggugaugcuccuggugcugugcgccguccagcuccugcugaugcgcaccagcugggcccucugcgaggcccugacgcuggcgaccggccccaucaccacccucugggagggcucccccgggaaguucuggaacacgaccaucgccgugagcauggccaacaucuuccggggcuccuaccuggccggggccggccuggcguucagcaucaugaaguccguggggaccggcaagcgcggcaccgggagccagggcgagacccucggggagaaguggaagaagaagcugaaccagcugagccggaaggaguucgaccucuacaagcgcuccggcaucacggaggucgaccggaccgaggccaaggaggggcugaagcgcggcgagaucacccaccacgccgugagccggggcuccgccaagcugcagugguucguggagcgcaacauggucaucccggaggggcgggugaucgaccucggcugcgggcgcggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccggacgauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugucccgcaacagcacccacgagauguacuggaucuccaacggcaccgggaacaucguggcgagcgugaacauggucucccggcuccugcugaaccgcuucacgaugacccaccggcgcccgaccaucgagaaggacguggaccucggcgccggcacccggcacgugaacgccgagcccgagacgcccaacauggacgucaucggggagcgcaucaagcggaucaaggaggagcacaacagcaccuggcacuacgacgaggagaacccguacaagaccugggccuaccacggcuccuacgaggugaaggccaccgggagcgcguccagcaugaucaacggcguggucaagcugcugacgaagcccugggacgugguccccauggugacccagauggccaugaccgacaccacgcccuucgggcagcagcgcguguucaaggagaaggucgacacccggaccccgcgcagcaugcccggcacccggcgcgugaugggcaucacggccgaguggcucuggcggacccuggggcgcaacaagaagccccgccugugcacccgggaggaguucaccaagaaggugcgcacgaacgccgcgaugggcgccgucuucaccgaggagaaccagugggacuccgccaaggccgccguggaggacgaggacuucuggaagcucguggaccgggagcgcgagcugcacaagcuggggaagugcggcagcugcgucuacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgcggacgacaccgccgggugggacacccgcaucacggaggacgaccugcacaacgaggagaagaucacccagcagauggacccggagcaccggcagcucgccaacgccaucuucaagcugaccuaccagaacaagguggucaaggugcagcgccccacccccaccggcacggugauggacaucaucagccggaaggaccagcgcggcuccgggcaggucggcaccuacgggcugaacaccuucaccaacauggaggcccagcucauccggcagauggagggcgagggggugcugagcaaggcggaccuggagaacccccaccucccggagaagaagaucacgcaguggcuggagaccaagggcguggagcgccugaagcggauggccaucuccggcgacgacugcgucgugaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcgcgcaucagccagggggccggcuggucccuccgggagaccgccugccugggcaaggccuacgcgcagauguggacccugauguacuuccaccgccgggaccuccgccuggccagcaacgccaucugcuccgccguccccgugcacugggugccgacgagccggaccaccugguccauccacgcccaccaccaguggaugaccacggaggacaugcugaccgucuggaaccgcguguggaucgaggacaaccccuggauggaggacaagacccccgugaccacgugggaggacguccccuaccucgggaagcgggaggaccaguggugcggcagccugaucgggcugaccagccgcgcgaccugggcccagaacaucccgaccgccauccagcagguccggucccucaucggcaacgaggaguuccuggacuacaugcccagcaugaagcgcuuccggaaggaggaggaguccgagggggccaucugguga

SEQ ID NO: 10104 - RNA, 9873 nt, Artificial Sequence
  derived and/or modified CDS sequence (opt1) from DENV-3__KJ189292__SS-prME
accagccucugccucaugaugauccugcccgccgcccuggccuuccaccucaccagccgcgacggggagccgcggaugaucguggggaagaacgagcgcggcaagagccugcuguucaagaccgccagcgggaucaacaugugcacccucaucgccauggaccugggggagaugugcgacgacaccgugaccuacaagugcccccacaucaccgaggccgagcccgaggacaucgacugcuggugcaaccugaccagcaccugggugaccuacgggaccugcaaccaggccggcgagcaccggcgcgacaagcgguccguggcgcucgcgccccacgugggcauggggcuggacacccgcacccagaccuggaugagcgccgagggcgccuggcggcaggucgagaagguggagaccugggcgcugcgccacccgggguucaccauccucgcccuguuccuggcccacuacaucggcaccucccucacccagaagguggugaucuucauccugcugaugcucgugacgcccagcaugaccaugcggugcgucggggugggcaaccgcgacuucguggagggccuguccggggccaccugggucgacguggugcuggagcacggcgggugcgucaccacgauggccaagaacaagcccacccucgacaucgagcugcagaagaccgaggcgacccagcuggccacgcuccggaagcugugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccacccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgcgaagaagcaggagguggucgugcuggggucccaggagggcgccaugcacacggcccucaccggggccaccgagauccagaacagcggcgggaccuccaucuucgccggccaccugaagugccggcugaagauggacaagcucgagcugaagggcaugagcuacgcgaugugcacgaacaccuucgugcugaagaaggaggucuccgagacccagcacgggaccauccucaucaagguggaguacaagggcgaggacgccccgugcaagauccccuucagcacggaggacgggcacggcaaggcccacaacggccgccugaucaccgccaaccccguggucaccaagaaggaggagcccgugaacaucgaggcggagccgcccuucggggagagcaacaucaugaucggcaucggggacaacgcccugaagaucaacugguacaagaagggcuccagcaucgggaagauguucgaggccaccgcccggggcgcccgccggauggcgauccugggcgacacggccugggacuucggguccgugggcgggguccucaacagccugggcaagauggugcaccagaucuucggguccgccuacaccgcccuguucagcggcguguccugggucaugaagaucggcaucggggugcuccugaccuggaucggccugaacagcaagaacaccuccaugagcuucuccugcaucgccaucgggaucaucacgcucuaccugggcgcggugguccaggccgacauggggugcaucaucaacuggaagggcaaggagcugaagugcggcagcgggaucuucgugaccaacgaggugcacaccuggaccgagcaguacaaguuccaggccgacucccccaagcgccucgccacggccaucgcgggcgccugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgcggagacgcagaacagcuccuucaucaucgacggccccaacacccccgagugccccagcgccucccgggccuggaacgucugggagguggaggacuacggguucggcguguucaccaccaacaucuggcuccgccugcgggaggucuacacccagcugugcgaccaccgccucaugagcgccgccgugaaggacgagcgggcggugcacgccgacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggucaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccuggucuccgcgggcagcgggaagguggacaacuucaccaugggcgugcugugccucgccauccuguucgaggaggucaugcgcgggaaguucggcaagaagcacaugaucgccgggguguucuucaccuucgugcugcuccuguccggccagaucaccuggcgggacauggcccacacgcugaucaugaucggcagcaacgccuccgaccgcauggggaugggcgucaccuaccucgcgcugaucgccaccuucaagauccagcccuuccuggcccucggguucuuccugcggaagcugaccagccgcgagaaccuccugcugggcgugggccucgccauggcgacgacccugcagcugcccgaggacaucgagcagauggccaacgggaucgcccucggccugauggcccugaagcucaucacccaguucgagaccuaccagcuguggacggcccugaucagccugaccugcuccaacaccaucuucacccugacgguggcguggcggaccgccacccugauccucgccggggucagccugcugccggugugccaguccagcuccaugcgcaagaccgacuggcuccccauggccguggccgcgaugggcgugccgccccucccgcuguucaucuucagccucaaggacacgcugaagcgccgguccuggccccugaacgagggggugauggccgucggccucgugagcauccuggccuccagccugcuccgcaacgacgugcccauggccggcccccuggucgccgggggccugcucaucgcgugcuacgugaucaccgggaccuccgccgaccugaccguggagaaggccgccgacaucacgugggaggaggaggccgagcagaccggcgucagccacaaccugaugaucaccguggacgacgacgggaccaugcggaucaaggacgacgagaccgagaacauccucacggugcugcugaagaccgcgcuccugaucgucuccggcaucuucccguacagcauccccgccacccugcucguguggcacaccuggcagaagcagacgcagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgccgugcucaccuacaacgggaagcggcuggagcccaacugggcguccgugaagaaggaccugaucagcuacggcgggggcuggcgccucuccacccaguggcagaagggggaggagguccaggugaucgccguggagcccggcaagaaccccaagaacuuccagaccauccccggcacguuccagaccaccaccggggagaucggcgccaucgcccuggacuucaagcccgggacgagcggcagccccaucaucaaccgggagggcaaggucguggggcuguacggcaacgggguggucaccaagaacggcggguacguguccggcaucgcccagaccaacgcggagccggacggcagcacccccgagcuggaggaggagauguucaagaagcgcaaccucacgaucauggaccugcaccccggguccggcaagacccggaaguaccugcccgccaucgugcgcgaggccaucaagcggcgccuccggacccugauccuggccccgacccgcgucguggccgcggagauggaggaggcccucaaggggcugcccauccgguaccagacgaccgccaccaagagcgagcacaccggccgcgagaucguggaccugaugugccacgccacguucaccaugcggcuccugucccccguccgcgugcccaacuacaaccugaucaucauggacgaggcccacuucaccgacccggcgagcaucgccgcccggggguacaucuccacccgcgugggcaugggcgaggccgcggccaucuucaugacggccacgccgcccgggaccgccgacgccuucccccagagcaacgcgccgauccaggacgaggagcgcgacauccccgagcgguccuggaacagcggcaacgaguggaucaccgacuucgccgggaagacggucugguucgugcccuccaucaaggccggcaacgacaucgccaacugccuccgcaagaacgggaagaaggugauccagcugagccggaagaccuucgacaccgaguaccagaagaccaagcugaacgacugggacuucgucgugacgaccgacaucuccgagaugggcgccaacuucaaggcggaccgcgugaucgacccccggcgcugccucaagccggucauccugaccgacggccccgagcgggugauccuggccgggcccaugcccgugaccgucgccagcgccgcccagcgccggggccgcguggggcggaacccgcagaaggagaacgaccaguacaucuucaccggccagccccucaacaacgacgaggaccacgcgcacuggacggaggccaagaugcugcuggacaacaucaacacccccgaggggaucauccccgcccucuucgagccggagcgcgagaaguccgccgcgaucgacggcgaguaccggcugaagggcgagagccgcaagaccuucguggagcugaugcggcgcggggaccuccccgucuggcuggcccacaagguggccuccgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacagcgacccccuggcccucaaggaguucaaggacuucgcggccggccggaaguccaucgcccuggaccuggucaccgagaucgggcgcgugccgagccaccucgcccaccggacccgcaacgcccuggacaaccuggucaugcuccacacgagcgagcacggcgggcgggcguaccgccacgccguggaggagcugcccgagaccauggagacccugcuccugcugggccucaugauccugcugaccgggggcgccaugcuguuccugaucuccggcaaggggaucggcaagacgagcaucgggcugaucugcgugaucgccuccagcggcaugcucuggauggccgagaucccccugcaguggaucgcguccgccaucguccuggaguucuucaugauggugcuccugaucccggagcccgagaagcagcggacgccccaggacaaccagcuggccuacguggucaucgggauccucacccuggccgccaucaucgcggccaacgagaugggccugcucgagaccacgaagcgcgaccugggcaugagcaaggagcccggggugguguccccgaccagcuaccuggacgucgaccuccaccccgccuccgccuggacccuguacgcgguggccaccacggugaucacccccaugcugcggcacaccaucgagaacagcaccgccaacgucucccucgccgccaucgcgaaccaggccguggugcugaugggccuggacaagggguggcccaucagcaagauggaccucggcgucccgcugcuggcccucgggugcuacucccaggugaacccccugacgcugaccgccgccgugcuccugcugaucacccacuacgcgaucaucggccccggccuccaggccaaggccacccgcgaggcccagaagcggacggccgcggggaucaugaagaaccccaccgucgacggcaucaugaccaucgaccuggacccggugaucuacgacagcaaguucgagaagcagcugggccaggugaugcuccugguccugugcgccgugcagcuccugcugaugcgcaccuccugggcccucugcgaggcccugacgcuggcgaccggccccaucaccacccucugggagggcagccccgggaaguucuggaacacgaccaucgccguguccauggccaacaucuuccggggcagcuaccuggccggggccggccuggcguucuccaucaugaaguccgucgggaccggcaagcgcggcaccgggagccagggcgagacccucggggagaaguggaagaagaagcugaaccagcugucccggaaggaguucgaccucuacaagaaguccggcaucacggagguggaccgcaccgaggccaaggaggggcugaagcggggcgagaucacccaccacgccgugucccgcggcagcgccaagcugcagugguucgucgagcggaacauggugauccccgaggggcgcgugaucgaccucggcugcgggcggggcgggugguccuacuacugcgccggccugaagaaggucaccgaggugcgcggcuacacgaagggcgggccggggcacgaggagcccgugcccaugagcaccuacggcuggaacaucgucaagcugauguccgggaaggacguguucuaccucccgcccgagaagugcgacacccugcugugcgacaucggcgagagcucccccagccccaccguggaggagucccgcacgauccggguccugaagaugguggagcccuggcucaagaacaaccaguucugcaucaaggugcugaaccccuacaugcccaccgucaucgagcaccuggagcgccuccagcggaagcacggcgggaugcuggugcgcaacccccugagccggaacuccacccacgagauguacuggaucagcaacggcaccgggaacaucguggcguccgucaacauggugagccgccuccugcugaaccgguucacgaugacccaccgccggcccaccaucgagaaggacguggaccucggcgccggcacccgccacgucaacgccgagccggagacgcccaacauggacgugaucggggagcggaucaagcgcaucaaggaggagcacaacuccaccuggcacuacgacgacgagaaccccuacaagaccugggccuaccacggcagcuacgaggugaaggccaccggguccgcgagcagcaugaucaacggcgucgugaagcugcugacgaagccgugggacgugguccccauggugacccagauggccaugaccgacaccacgcccuucgggcagcagcgggucuucaaggagaagguggacacccgcacgccccgguccaugccgggcacccgccgggugaugggcaucacggccgaguggcucuggcgcacccuggggcggaacaagaagccccgccugugcacccgcgaggaguucaccaagaagguccggacgaacgccgcgaugggcgccguguucaccgaggagaaccagugggacagcgccaaggccgccguggaggacgaggacuucuggaagcucgucgaccgcgagcgggagcugcacaagcuggggaagugcggcuccugcguguacaacaugauggggaagcgcgagaagaagcucggcgaguucggcaaggcgaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgcggacgacaccgccgggugggacacccggaucacggaggacgaccugcacaacgaggagaagaucacccagcagauggaccccgagcaccgccagcucgccaacgccaucuucaagcugaccuaccagaacaaggucgugaaggugcagcggccgacccccaccggcacggucauggacaucaucucccgcaaggaccagcggggcagcggccaggugggcaccuacgggcugaacaccuucaccaacauggaggugcagcucauccgccagauggagggcgaggggguccuguccaaggccgaccuggagaacccccaccuccccgagaagaagaucacgcaguggcuggagaccaagggcguggagcggcugaagcgcauggcgaucagcggcgacgacugcguggucaagccgaucgacgaccgguucgccaacgcccuccuggcccugaacgacauggggaagauccgcaaggacaucccccaguggcagcccuccaagggcuggcacgacuggcagcagguccccuucugcagccaccacuuccacgagcucaucaugaaggacgggcggaagcugguggucccgugccgcccccaggacgagcugaucggccgggcccgcaucucccagggggcgggcuggagccuccgcgagaccgccugccugggcaaggccuacgcccagauguggucccugauguacuuccaccggcgcgaccuccggcuggcgagcaacgccaucugcuccgccgugcccgugcacuggguccccaccagccgcacgaccuggagcauccacgcccaccaccaguggaugaccaccgaggacaugcugacgguguggaaccggguguggaucgaggacaacccguggauggaggacaagacccccgucaccaccugggaggacgugcccuaccucgggaagcgcgaggaccaguggugcggcucccugaucgggcugacgagccgggccaccugggcgcagaacauccccaccgccauccagcagguccgcucccucaucggcaacgaggaguuccuggacuacaugccgagcaugaagcgguuccgcaaggaggaggaguccgagggggccaucugguga

SEQ ID NO: 10105 - RNA, 9873 nt, Artificial Sequence
  derived and/or modified CDS sequence (opt1) from DENV-3__KJ189293__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcuccgccugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggucaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgcgauccuguucgaggaggucaugcgcgggaaguucggcaagaagcacaugaucgccgggguguucuucaccuucgugcugcuccuguccggccagaucaccuggcgggacauggcccacacgcugaucaugaucggcagcaacgccuccgaccgcauggggaugggcgucaccuaccucgcccugaucgcgaccuucaagauccagcccuuccuggcccucggguucuuccugcggaagcugaccagccgcgagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccaucuucacccugacgguggccuggcggaccgcgacccugauccucgccggggucagccugcugccggugugccaguccagcuccaugcgcaagaccgacuggcuccccauggccgucgccgccaugggcgugccgccccucccgcuguucaucuucagccucaaggacacgcugaagcgccgguccuggccccugaacgagggggugauggcggucggccucgugagcauccuggccuccagccugcuccgcaacgacgugcccauggccggcccccuggucgccgggggccugcucaucgccugcuacgugaucaccgggaccuccgcggaccugaccguggagaaggccgccgacaucacgugggaggaggaggccgagcagaccggcgucagccacaaccugaugaucaccguggacgacgacgggaccaugcggaucaaggacgacgagaccgagaacauccucacggugcugcugaagaccgcccuccugaucgucuccggcaucuucccguacagcauccccgcgacccugcucguguggcacaccuggcagaagcagacgcagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgccgugcucaccuacaacgggaagcggcuggagcccaacugggccuccgugaagaaggaccugaucagcuacggcgggggcuggcgccucuccacccaguggcagaagggggaggagguccaggugaucgcgguggagcccggcaagaaccccaagaacuuccagaccaugcccggcacguuccagaccaccaccggggagaucggcgccaucgcccuggacuucaagcccgggacgagcggcagccccaucaucaaccgggagggcaaggucguggggcuguacggcaacgggguggucaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggcgaucgugcgcgaggccaucaagcggcgccuccggacccugauccuggcccccacccgcgucguggccgccgagauggaggaggcgcucaaggggcugcccauccgguaccagacgaccgccaccaaguccgagcacaccggccgcgagaucguggaccugaugugccacgccacguucaccaugcggcuccugagccccguccgcgugccgaacuacaaccugaucaucauggacgaggcccacuucaccgaccccgccuccaucgcggcccggggguacaucagcacccgcgugggcaugggcgaggccgccgcgaucuucaugacggccacgccgcccgggaccgccgacgccuucccgcaguccaacgcccccauccaggacgaggagcgcgacauccccgagcggagcuggaacuccggcaacgaguggaucaccgacuucgcggggaagacggucugguucgugcccagcaucaaggccggcaacgacaucgccaacugccuccgcaagaacgggaagaaggugauccagcugucccggaagaccuucgacaccgaguaccagaagaccaagcugaacgacugggacuucgucgugacgaccgacaucagcgagaugggcgccaacuucaaggccgaccgcgugaucgacccgcggcgcugccucaagcccgucauccugaccgacggccccgagcgggugauccuggcggggcccaugccggugaccgccgccuccgccgcccagcgccggggccgcgucgggcggaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgcgagaaguccgccgcgaucgacggcgaguaccggcugaagggcgagucccgcaagaccuucguggagcugaugcggcgcggggaccuccccguguggcuggcccacaaggucgccagcgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacuccgacccgcuggcccucaaggaguucaaggacuucgcggccggccgcaagagcaucgcccuggaccuggucaccgagaucgggcgcgugcccucccaccucgcccaccggacccgcaacgcccuggacaaccuggugaugcuccacacgagcgagcacggcgggcgggcguaccgccacgccgucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucgugcuggaguucuucaugaugguccuccugauccccgagcccgagaagcagcggacgccccaggacaaccagcuggccuacguggugaucgggauccucacccuggccgccaucaucgcggccaacgagaugggccugcucgagaccacgaagcgcgaccugggcauguccaaggagccgggggucgugagccccaccuccuaccuggacguggaccuccaccccgccagcgccuggacccuguacgcggucgccaccacggugaucacccccaugcugcggcacaccaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacgcugaccgccgccgugcuccugcugaucacccacuacgcgaucaucggccccggccuccaggccaaggccacccgcgaggcccagaagcggacggccgcggggaucaugaagaacccgaccguggacggcaucaugaccaucgaccuggaccccgucaucuacgacuccaaguucgagaagcagcugggccaggugaugcuccuggugcugugcgccguccagcuccugcugaugcgcaccagcugggcccucugcgaggcccugacgcuggcgaccggccccaucaccacccucugggagggcucccccgggaaguucuggaacacgaccaucgccgugagcauggccaacaucuuccggggcuccuaccuggccggggccggccuggcguucagcaucaugaaguccguggggaccggcaagcgcggcaccgggagccagggcgagacccucggggagaaguggaagaagaagcugaaccagcugagccggaaggaguucgaccucuacaagaaguccggcaucacggaggucgaccgcaccgaggccaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccgcacgauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugucccggaacagcacccacgagauguacuggaucuccaacggcaccgggaacaucguggcgagcgugaacauggucucccgccuccugcugaaccgguucacgaugacccaccgccggccgaccaucgagaaggacguggaccucggcgccggcacccgccacgugaacgccgagcccgagacgcccaacauggacgucaucggggagcggaucaagcgcaucaaggaggagcacaacagcaccuggcacuacgacgacgagaacccguacaagaccugggccuaccacggcuccuacgaggugaaggccaccgggagcgcguccagcaugaucaacggcguggucaagcugcugacgaagcccugggacgugguccccauggugacccagauggccaugaccgacaccacgcccuucgggcagcagcggguguucaaggagaaggucgacacccgcaccccgcggagcaugcccggcacccgccgggugaugggcaucacggccgaguggcucuggcgcacccuggggcggaacaagaagccccgccugugcacccgcgaggaguucaccaagaaggugcggacgaacgccgcgaugggcgccgucuucaccgaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacaccgccgggugggacacccggaucacggaggacgaccugcacaacgaggagaagaucacccagcagauggacccggagcaccgccagcucgccaacgccaucuucaagcugaccuaccagaacaagguggucaaggugcagcggcccacccccaccggcacggugauggacaucaucagccgcaaggaccagcggggcuccgggcaggucggcaccuacgggcugaacaccuucaccaacauggaggcccagcucauccgccagauggagggcgagggggugcugagcaaggcggaccuggagaacccccaccucccggagaagaagaucacgcaguggcuggagaccaagggcguggagcggcugaagcgcauggccaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcgcgcaucagccagggggccggcuggucccuccgcgagaccgccugccugggcaaggccuacgcgcagauguggagccugauguacuuccaccggcgcgaccuccggcuggccuccaacgccaucugcagcgccguccccgugcacugggugccgaccucccgcacgaccuggagcauccacgcccaccaccaguggaugaccaccgaggacaugcugacggucuggaaccggguguggaucgaggacaaccccuggauggaggacaagacccccgugaccaccugggaggacguccccuaccucgggaagcgcgaggaccaguggugcggcagccugaucgggcugacgucccgggcgaccugggcccagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10106 - RNA, 9873 nt, Artificial Sequence
  derived and/or modified CDS sequence (opt1) from DENV-3__KJ189294__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcauccucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgugugggaggucgaggacuacggguucggcguguucaccaccaacaucuggcuccgccugcgggagguguacacccagcugugcgaccaccgccucaugagcgccgccgucaaggacgagcgggccgugcacgcggacaugggcuacuggaucgagagccagaagaacggguccuggaagcuggagaaggccagccugaucgaggugaagacgugcaccuggccgaagucccacacccucuggagcaacggcguccuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggugaucaccgagaacugcgggacgcggggccccagccuccgcaccaccaccgucuccgggaagcugauccacgaguggugcugccggagcugcacgcugcccccgcuccgcuacaugggcgaggacgggugcugguacggcauggagauccggcccaucuccgagaaggaggagaacauggucaagagccugguguccgccggcagcgggaaggucgacaacuucaccaugggcgugcugugccucgcgauccuguucgaggaggugaugcgcgggaaguucggcaagaagcacaugaucgccggggucuucuucaccuucgugcugcuccuguccggccagaucaccuggcgggacauggcccacacgcugaucaugaucggcagcaacgccuccgaccgcauggggaugggcgugaccuaccucgcccugaucgcgaccuucaagauccagcccuuccuggcccucggguucuuccugcggaagcugaccagccgcgagaaccuccugcugggcgucggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccaucuucacccugacgguggccuggcggaccgcgacccugauccucgccggggugagccugcugccggucugccaguccagcuccaugcgcaagaccgacuggcuccccauggccguggccgccaugggcgugccgccccucccgcuguucaucuucagccucaaggacacgcugaagcgccgguccuggccccugaacgagggggugauggcggugggccucgucagcauccuggccuccagccugcuccgcaacgacgugcccauggccggcccccugguggccgggggccugcucaucgccugcuacgucaucaccgggaccuccgcggaccugaccguggagaaggccgccgacaucacgugggaggaggaggccgagcagaccggcgugagccacaaccugaugaucaccgucgacgacgacgggaccaugcggaucaaggacgacgagaccgagaacauccucacggugcugcugaagaccgcccuccugaucguguccggcaucuucccguacagcauccccgcgacccugcucgucuggcacaccuggcagaagcagacgcagcgcuccggcgugcugugggacgugcccagcccgcccgagacccagaaggccgagcuggaggagggggucuaccggaucaagcagcagggcaucuucgggaagacccaggugggcguggggguccagaaggagggcguguuccacaccauguggcacgugacgcgcggcgccguccucaccuacaacgggaagcggcuggagcccaacugggccuccgugaagaaggaccugaucagcuacggcgggggcuggcgccucuccacccaguggcagaagggggaggaggugcaggucaucgcgguggagcccggcaagaaccccaagaacuuccagaccaugcccggcacguuccagaccaccaccggggagaucggcgccaucgcccuggacuucaagcccgggacgagcggcagccccaucaucaaccgggagggcaagguggucgggcuguacggcaacgggguggugaccaagaacggcggguacgucuccggcaucgcccagaccaacgccgagccggacggccccacccccgagcuggaggaggagauguucaagaagcgcaaccucacgaucauggaccugcaccccgggagcggcaagacccggaaguaccugccggcgaucgugcgcgaggccaucaagcggcgccuccggacccugauccuggcccccacccgcguggucgccgccgagauggaggaggcgcucaaggggcugcccauccgguaccagacgaccgccaccaaguccgagcacaccggccgcgagaucguggaccugaugugccacgccacguucaccaugcggcuccugagccccgugcgcgucccgaacuacaaccugaucaucauggacgaggcccacuucaccgaccccgccuccaucgcggcccggggguacaucagcacccgcgugggcaugggcgaggccgccgcgaucuucaugacggccacgccgcccgggaccgccgacgccuucccgcaguccaacgcccccauccaggacgaggagcgcgacauccccgagcggagcuggaacuccggcaacgaguggaucaccgacuucgcggggaagacggugugguucguccccagcaucaaggccggcaacgacaucgccaacugccuccgcaagaacgggaagaaggugauccagcugucccggaagaccuucgacaccgaguaccagaagaccaagcugaacgacugggacuucguggucacgaccgacaucagcgagaugggcgccaacuucaaggccgaccgcgugaucgacccgcggcgcugccucaagcccgugauccugaccgacggccccgagcgggucauccuggcggggcccaugccggugaccgccgccuccgccgcccagcgccggggccgcguggggcggaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgcgagaaguccgccgcgaucgacggcgaguaccggcugaagggcgagucccgcaagaccuucgucgagcugaugcggcgcggggaccuccccguguggcuggcccacaagguggccagcgagggcaucaaguacaccgaccggaaguggugcuucgacgggcagcgcaacaaccagauccuggaggagaacauggacgucgagaucuggacgaaggagggcgagaagaagaagcuccggccccgcuggcuggacgcccgcaccuacuccgacccgcuggcccucaaggaguucaaggacuucgcggccggccgcaagagcaucgcccuggaccuggugaccgagaucgggcgcguccccucccaccucgcccaccggacccgcaacgcccuggacaaccuggugaugcuccacacgagcgagcacggcgggcgggcguaccgccacgccguggaggagcugcccgagaccauggagacccugcuccugcugggccucaugauccugcugaccgggggcgccaugcuguuccugaucagcggcaaggggaucggcaagacguccaucgggcugaucugcgucaucgccagcuccggcaugcucuggauggccgagaucccgcugcaguggaucgcgagcgccaucgugcuggaguucuucaugauggugcuccugauccccgagcccgagaagcagcggacgccccaggacaaccagcuggccuacgucgugaucgggauccucacccuggccgccaucaucgcggccaacgagaugggccugcucgagaccacgaagcgcgaccugggcauguccaaggagccggggguggucagccccaccuccuaccuggacguggaccuccaccccgccagcgccuggacccuguacgcgguggccaccacggucaucacccccaugcugcggcacaccaucgagaacuccaccgccaacgugagccucgccgccaucgcgaaccaggccgugguccugaugggccuggacaagggguggccgaucuccaagauggaccucggcgugccccugcuggcccucgggugcuacagccaggugaacccccugacgcugaccgccgccguccuccugcugaucacccacuacgcgaucaucggccccggccuccaggccaaggccacccgcgaggcccagaagcggacggccgcggggaucaugaagaacccgaccguggacggcaucaugaccaucgaccuggaccccgugaucuacgacuccaaguucgagaagcagcuggggcaggucaugcuccuggugcugugcgccgugcagcuccugcugaugcgcaccagcugggcccucugcgaggcccugacgcuggcgaccggccccaucaccacccucugggagggcucccccgggaaguucuggaacacgaccaucgccgucagcauggccaacaucuuccggggcuccuaccuggccggggccggccuggcguucagcaucaugaaguccguggggaccggcaagcgcggcaccgggagccagggcgagacccucggggagaaguggaagaagaagcugaaccagcugagccggaaggaguucgaccucuacaagaaguccggcaucacggagguggaccgcaccgaggccaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacacgaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccaccgucgaggagagccgcacgauccgggugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacccacgagauguacuggaucuccaacggcaccgggaacaucgucgcgagcgugaacauggugucccgccuccugcugaaccgguucacgaugacccaccgccggccgaccaucgagaaggacgucgaccucggcgccggcacccgccacgugaacgccgagcccgagacgcccaacauggacgugaucggggagcggaucaagcgcaucaaggaggagcacaacagcaccuggcacuacgacgacgagaacccguacaagaccugggccuaccacggcuccuacgaggucaaggccaccgggagcgcguccagcaugaucaacggcguggugaagcugcugacgaagcccugggacgucgugcccauggucacccagauggccaugaccgacaccacgcccuucgggcagcagcggguguucaaggagaagguggacacccgcaccccgcggagcaugcccggcacccgccgggucaugggcaucacggccgaguggcucuggcgcacccuggggcggaacaagaagccccgccugugcacccgcgaggaguucaccaagaaggugcggacgaacgccgcgaugggcgccguguucaccgaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgcggacgacaccgccgggugggacacccggaucacggaggacgaccugcacaacgaggagaagaucacccagcagauggacccggagcaccgccagcucgccaacgccaucuucaagcugaccuaccagaacaagguggugaagguccagcggcccacccccaccggcacggugauggacaucaucagccgcaaggaccagcggggcuccggccaggugggcaccuacgggcugaacaccuucaccaacauggaggcccagcucauccgccagauggagggcgaggggguccugagcaaggcggaccuggagaacccccaccucccggagaagaagaucacgcaguggcuggagaccaagggcguggagcggcugaagcgcauggccaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcgcgcaucagccagggggccggcuggucccuccgcgagaccgccugccugggcaaggccuacgcgcagauguggagccugauguacuuccaccggcgcgaccuccggcuggccuccaacgccaucugcagcgccgugcccguccacugggugccgaccucccgcacgaccuggagcauccacgcccaccaccaguggaugaccaccgaggacaugcugacgguguggaaccgggucuggaucgaggacaaccccuggauggaggacaagacccccgugaccaccugggaggacgugcccuaccucgggaagcgcgaggaccaguggugcggcagccugaucgggcugacgucccgggcgaccugggcccagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10107 - RNA, 9873 nt, Artificial Sequence
  derived and/or modified CDS sequence (opt1) from DENV-3__KJ189295__SS-prME
accagccugugccucaugaugauccugcccgccgcccuggcguuccaccucaccagccgggacggggagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcuccgccugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggucaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgcgauccuguucgaggaggucaugcgcgggaaguucggcaagaagcacaugaucgccgggguguucuucaccuucgugcugcuccuguccggccagaucaccuggcgggacauggcccacacgcugaucaugaucggcagcaacgccuccgaccgcauggggaugggcgucaccuaccucgcccugaucgcgaccuucaagauccagcccuuccuggcccucggguucuuccugcggaagcugaccagccgcgagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccaucuucacccugacgguggccuggcggaccgcgacccugauccucgccggggucagccugcugccggugugccaguccagcuccaugcgcaagaccgacuggcuccccauggccgucgccgccaugggcgugccgccccucccgcuguucaucuucagccucaaggacacgcugaagcgccgguccuggccccugaacgagggggugauggcggucggccucgugagcauccuggccuccagccugcuccgcaacgacgugcccauggccggcccccuggucgccgggggccugcucaucgccugcuacgugaucaccgggaccuccgcggaccugaccguggagaaggccgccgacaucacgugggaggaggaggccgagcagaccggcgucagccacaaccugaugaucaccguggacgacgacgggaccaugcggaucaaggacgacgagaccgagaacauccucacggugcugcugaagaccgcccuccugaucgucuccggcaucuucccguacagcauccccgcgacccugcucguguggcacaccuggcagaagcagacgcagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgccgugcucaccuacaacgggaagcggcuggagcccaacugggccuccgugaagaaggaccugaucagcuacggcgggggcuggcgccucuccacccaguggcagaagggggaggagguccaggugaucgcgguggagcccggcaagaaccccaagaacuuccagaccaugcccggcacguuccagaccaccaccggggagaucggcgccaucgcccuggacuucaagcccgggacgagcggcagccccaucaucaaccgggagggcaaggucguggggcuguacggcaacgggguggucaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggcgaucgugcgcgaggccaucaagcggcgccuccggacccugauccuggcccccacccgcgucguggccgccgagauggaggaggcgcucaaggggcugcccauccgguaccagacgaccgccaccaaguccgagcacaccggccgcgagaucguggaccugaugugccacgccacguucaccaugcggcuccugagccccguccgcgugccgaacuacaaccugaucaucauggacgaggcccacuucaccgaccccgccuccaucgcggcccggggguacaucagcacccgcgugggcaugggcgaggccgccgcgaucuucaugacggccacgccgcccgggaccgccgacgccuucccgcaguccaacgcccccauccaggacgaggagcgcgacauccccgagcggagcuggaacuccggcaacgaguggaucaccgacuucgcggggaagacggucugguucgugcccagcaucaaggccggcaacgacaucgccaacugccuccgcaagaacgggaagaaggugauccagcugucccggaagaccuucgacaccgaguaccagaagaccaagcugaacgacugggacuucgucgugacgaccgacaucagcgagaugggcgccaacuucaaggccgaccgcgugaucgacccgcggcgcugccucaagcccgucauccugaccgacggccccgagcgggugauccuggcggggcccaugccggugaccgccgccuccgccgcccagcgccggggccgcgucgggcggaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgcgagaaguccgccgcgaucgacggcgaguaccggcugaagggcgagucccgcaagaccuucguggagcugaugcggcgcggggaccuccccguguggcuggcccacaaggucgccagcgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacuccgacccgcuggcccucaaggaguucaaggacuucgcggccggccgcaagagcaucgcccuggaccuggucaccgagaucgggcgcgugcccucccaccucgcccaccggacccgcaacgcccuggacaaccuggugaugcuccacacgagcgagcacggcgggcgggcguaccgccacgccgucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucgugcuggaguucuucaugaugguccuccugauccccgagcccgagaagcagcggacgccccaggacaaccagcuggccuacguggugaucgggauccucacccuggccgccaucaucgcggccaacgagaugggccugcucgagaccacgaagcgcgaccugggcauguccaaggagccgggggucgugagccccaccuccuaccuggacguggaccuccaccccgccagcgccuggacccuguacgcggucgccaccacggugaucacccccaugcugcggcacaccaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacgcugaccgccgccgugcuccugcugaucacccacuacgcgaucaucggccccggccuccaggccaaggccacccgcgaggcccagaagcggacggccgcggggaucaugaagaacccgaccguggacggcaucaugaccaucgaccuggaccccgucaucuacgacuccaaguucgagaagcagcugggccaggugaugcuccuggugcugugcgccguccagcuccugcugaugcgcaccagcugggcccucugcgaggcccugacgcuggcgaccggccccaucaccacccucugggagggcucccccgggaaguucuggaacacgaccaucgccgugagcauggccaacaucuuccggggcuccuaccuggccggggccggccuggcguucagcaucaugaaguccguggggaccggcaagcgcggcaccgggagccagggcgagacccucggggagaaguggaagaagaagcugaaccagcugagccggaaggaguucgaccucuacaagaaguccggcaucacggaggucgaccgcaccgaggccaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccgcacgauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugucccggaacagcacccacgagauguacuggaucuccaacggcaccgggaacaucguggcgagcgugaacauggucucccgccuccugcugaaccgguucacgaugacccaccgccggccgaccaucgagaaggacguggaccucggcgccggcacccgccacgugaacgccgagcccgagacgcccaacauggacgucaucggggagcggaucaagcgcaucaaggaggagcacaacagcaccuggcacuacgacgacgagaacccguacaagaccugggccuaccacggcuccuacgaggugaaggccaccgggagcgcguccagcaugaucaacggcguggucaagcugcugacgaagcccugggacgugguccccauggugacccagauggccaugaccgacaccacgcccuucgggcagcagcggguguucaaggagaaggucgacacccgcaccccgcggagcaugcccggcacccgccgggugaugggcaucacggccgaguggcucuggcgcacccuggggcggaacaagaagccccgccugugcacccgcgaggaguucaccaagaaggugcggacgaacgccgcgaugggcgccgucuucaccgaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacaccgccgggugggacacccggaucacggaggacgaccugcacaacgaggagaagaucacccagcagauggacccggagcaccgccagcucgccaacgccaucuucaagcugaccuaccagaacaagguggucaaggugcagcggcccacccccaccggcacggugauggacaucaucagccgcaaggaccagcggggcuccgggcaggucggcaccuacgggcugaacaccuucaccaacauggaggcccagcucauccgccagauggagggcgagggggugcugcugaaggcggaccucgagaacccccaccuccccgagaagaagaucacgcaguggcuggagaccaagggcguggagcggcucaagcgcauggccaucagcggcgacgacugcgucgugaagcccaucgacgaccgguucgccaacgcccugcuggcccucaacgacauggggaaggugcgcaaggacaucccccaguggcagcccuccaagggcuggcacgacuggcagcaggucccguucugcagccaccacuuccacgagcugaucaugaaggacgggcggaagcugguggugcccugccgcccccaggacgagcucaucggccgggcgcgcaucucccagggggccggcuggagccugcgcgagaccgccugccugggcaaggccuacgcgcagauguggucccucauguacuuccaccggcgcgaccugcggcuggccagcaacgccaucugcuccgccguccccgugcacugggugccgaccagccgcacgaccugguccauccacgcccaccaccaguggaugaccaccgaggacaugcucacggucuggaaccggguguggaucgaggacaaccccuggauggaggaccgcacccccgugaccaccugggaggacguccccuaccuggggaagcgggaggaccaguggugcggcagccugaucgggcucacgagccgcgcgaccugggcccagaacaucccgaccgccauccagcagguccggucccugaucggcaacgaggaguuccuggacuacaugcccagcaugaagcgcuuccggaaggaggaggaguccgagggggccaucugguga
